United States Patent 11,446,398 (REGULATED BIOCIRCUIT SYSTEMS) - sequence listing, part 17

SEQ ID NO: 74442 - protein, 549 aa, Homo sapiens
  Payload ID: 14713
  Gene Symbol: RPS6KA5
  Gene Name: ribosomal protein S6 kinase, 90kDa, polypeptide 5
  Uniprot ID: O75582
  ENSP ID: ENSP00000402787
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPEV

SEQ ID NO: 74443 - protein, 723 aa, Homo sapiens
  Payload ID: 14713
  Gene Symbol: RPS6KA5
  Gene Name: ribosomal protein S6 kinase, 90kDa, polypeptide 5
  Uniprot ID: O75582
  ENSP ID: ENSP00000442803
MKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSVA

SEQ ID NO: 74444 - protein, 219 aa, Homo sapiens
  Payload ID: 14713
  Gene Symbol: RPS6KA5
  Gene Name: ribosomal protein S6 kinase, 90kDa, polypeptide 5
  ENSP ID: ENSP00000450591
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADELEIKSLFCLFVQD

SEQ ID NO: 74445 - protein, 79 aa, Homo sapiens
  Payload ID: 14713
  Gene Symbol: RPS6KA5
  Gene Name: ribosomal protein S6 kinase, 90kDa, polypeptide 5
  ENSP ID: ENSP00000451305
  MOD_RES (1)..(1): Any amino acid
XYGKVFLVRKISGHDTGKLYAMKVLKKATIVQKAKTTEHTRTERQVLEHIRQSPFLVTLHYAFQTETKLHLILVGDYIS

SEQ ID NO: 74446 - protein, 83 aa, Homo sapiens
  Payload ID: 14713
  Gene Symbol: RPS6KA5
  Gene Name: ribosomal protein S6 kinase, 90kDa, polypeptide 5
  ENSP ID: ENSP00000451736
MEEEGGSSGGAAGTSADGGDGGEQLLTVKHELRTETSLLCCPGWSVVLISAHYNLRLLGSSDSPASASQVAGITGTHYHTQLI

SEQ ID NO: 74447 - protein, 802 aa, Homo sapiens
  Payload ID: 14713
  Gene Symbol: RPS6KA5
  Gene Name: ribosomal protein S6 kinase, 90kDa, polypeptide 5
  Uniprot ID: O75582
  ENSP ID: ENSP00000479667
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSVA

SEQ ID NO: 74448 - protein, 745 aa, Homo sapiens
  Payload ID: 14714
  Gene Symbol: RPS6KA6
  Gene Name: ribosomal protein S6 kinase, 90kDa, polypeptide 6
  Uniprot ID: Q9UK32
  ENSP ID: ENSP00000262752
MLPFAPQDEPWDREMEVFSGGGASSGEVNGLKMVDEPMEEGEADSCHDEGVVKEIPITHHVKEGYEKADPAQFELLKVLGQGSFGKVFLVRKKTGPDAGQLYAMKVLKKASLKVRDRVRTKMERDILVEVNHPFIVKLHYAFQTEGKLYLILDFLRGGDVFTRLSKEVLFTEEDVKFYLAELALALDHLHQLGIVYRDLKPENILLDEIGHIKLTDFGLSKESVDQEKKAYSFCGTVEYMAPEVVNRRGHSQSADWWSYGVLMFEMLTGTLPFQGKDRNETMNMILKAKLGMPQFLSAEAQSLLRMLFKRNPANRLGSEGVEEIKRHLFFANIDWDKLYKREVQPPFKPASGKPDDTFCFDPEFTAKTPKDSPGLPASANAHQLFKGFSFVATSIAEEYKITPITSANVLPIVQINGNAAQFGEVYELKEDIGVGSYSVCKRCIHATTNMEFAVKIIDKSKRDPSEEIEILMRYGQHPNIITLKDVFDDGRYVYLVTDLMKGGELLDRILKQKCFSEREASDILYVISKTVDYLHCQGVVHRDLKPSNILYMDESASADSIRICDFGFAKQLRGENGLLLTPCYTANFVAPEVLMQQGYDAACDIWSLGVLFYTMLAGYTPFANGPNDTPEEILLRIGNGKFSLSGGNWDNISDGAKDLLSHMLHMDPHQRYTAEQILKHSWITHRDQLPNDQPKRNDVSHVVKGAMVATYSALTHKTFQPVLEPVAASSLAQRRSMKKRTSTGL

SEQ ID NO: 74449 - protein, 745 aa, Homo sapiens
  Payload ID: 14714
  Gene Symbol: RPS6KA6
  Gene Name: ribosomal protein S6 kinase, 90kDa, polypeptide 6
  Uniprot ID: Q9UK32
  ENSP ID: ENSP00000483896
MGLSTSAIWKNTRVEIVNPYEVKRKVKVNGLKMVDEPMEEGEADSCHDEGVVKEIPITHHVKEGYEKADPAQFELLKVLGQGSFGKVFLVRKKTGPDAGQLYAMKVLKKASLKVRDRVRTKMERDILVEVNHPFIVKLHYAFQTEGKLYLILDFLRGGDVFTRLSKEVLFTEEDVKFYLAELALALDHLHQLGIVYRDLKPENILLDEIGHIKLTDFGLSKESVDQEKKAYSFCGTVEYMAPEVVNRRGHSQSADWWSYGVLMFEMLTGTLPFQGKDRNETMNMILKAKLGMPQFLSAEAQSLLRMLFKRNPANRLGSEGVEEIKRHLFFANIDWDKLYKREVQPPFKPASGKPDDTFCFDPEFTAKTPKDSPGLPASANAHQLFKGFSFVATSIAEEYKITPITSANVLPIVQINGNAAQFGEVYELKEDIGVGSYSVCKRCIHATTNMEFAVKIIDKSKRDPSEEIEILMRYGQHPNIITLKDVFDDGRYVYLVTDLMKGGELLDRILKQKCFSEREASDILYVISKTVDYLHCQGVVHRDLKPSNILYMDESASADSIRICDFGFAKQLRGENGLLLTPCYTANFVAPEVLMQQGYDAACDIWSLGVLFYTMLAGYTPFANGPNDTPEEILLRIGNGKFSLSGGNWDNISDGAKDLLSHMLHMDPHQRYTAEQILKHSWITHRDQLPNDQPKRNDVSHVVKGAMVATYSALTHKTFQPVLEPVAASSLAQRRSMKKRTSTGL

SEQ ID NO: 74450 - protein, 549 aa, Homo sapiens
  Payload ID: 14715
  Gene Symbol: RPS6KL1
  Gene Name: ribosomal protein S6 kinase-like 1
  Uniprot ID: Q9Y6S9
  ENSP ID: ENSP00000346644
MSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAGFSSLRLRPIRTLSSAVEQLRGCRVVGVIEKVQLVQDPATGGTFVVKSLPRCHMVSRERLTIIPHGVPYMTKLLRYFVSEDSIFLHLEHVQGGTLWSHLLSQAHSRHSGLSSGSTQERMKAQLNPHLNLLTPARLPSGHAPGQDRIALEPPRTSPNLLLAGEAPSTRPQREAEGEPTARTSTSGSSDLPKAPGGHLHLQARRAGQNSDAGPPRGLTWVPEGAGPVLGGCGRGMDQSCLSADGAGRGCGRATWSVREEQVKQWAAEMLVALEALHEQGVLCRDLHPGNLLLDQAGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVG

SEQ ID NO: 74451 - protein, 549 aa, Homo sapiens; identical to SEQ ID NO: 74450
  Payload ID: 14715
  Gene Symbol: RPS6KL1
  Gene Name: ribosomal protein S6 kinase-like 1
  Uniprot ID: Q9Y6S9
  ENSP ID: ENSP00000450567

SEQ ID NO: 74452 - protein, 541 aa, Homo sapiens
  Payload ID: 14715
  Gene Symbol: RPS6KL1
  Gene Name: ribosomal protein S6 kinase-like 1
  Uniprot ID: Q9Y6S9
  ENSP ID: ENSP00000450660
MSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAVQLVQDPATGGTFVVKSLPRCHMVSRERLTIIPHGVPYMTKLLRYFVSEDSIFLHLEHVQGGTLWSHLLSQAHSRHSGLSSGSTQERMKAQLNPHLNLLTPARLPSGHAPGQDRIALEPPRTSPNLLLAGEAPSTRPQREAEGEPTARTSTSGSSDLPKAPGGHLHLQARRAGQNSDAGPPRGLTWVPEGAGPVLGGCGRGMDQSCLSADGAGRGCGRATWSVREEQVKQWAAEMLVALEALHEQGVLCRDLHPGNLLLDQAGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVGTSLETHLRTLIHWLSGPKPDCPG

SEQ ID NO: 74453 - protein, 157 aa, Homo sapiens
  Payload ID: 14715
  Gene Symbol: RPS6KL1
  Gene Name: ribosomal protein S6 kinase-like 1
  ENSP ID: ENSP00000450846
TIIPHGVPYMTKLLRYFVSEDSIFLHLEHVQGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVG

SEQ ID NO: 74454 - protein, 45 aa, Homo sapiens
  Payload ID: 14715
  Gene Symbol: RPS6KL1
  Gene Name: ribosomal protein S6 kinase-like 1
  ENSP ID: ENSP00000450968
ALSQSHPSGIQAHTQLQLPEWLSRPAASLLTEVRCSPARGSSCLA

SEQ ID NO: 74455 - protein, 104 aa, Homo sapiens
  Payload ID: 14715
  Gene Symbol: RPS6KL1
  Gene Name: ribosomal protein S6 kinase-like 1
  ENSP ID: ENSP00000451152
  MOD_RES (1)..(1): Any amino acid
XIFLHLEHVQGHIRLTYFGQWSEVEPQCCGEAVDNLYSAPEVGGISELTEACDWWSFGSLLYELLTGMLLQFEPTRRLGMGEGGVSKLKSHPFFSTIQWSKLVG

SEQ ID NO: 74456 - protein, 8 aa, Homo sapiens
  Payload ID: 14715
  Gene Symbol: RPS6KL1
  Gene Name: ribosomal protein S6 kinase-like 1
  ENSP ID: ENSP00000451338
MSLVACEC

SEQ ID NO: 74457 - protein, 74 aa, Homo sapiens
  Payload ID: 14715
  Gene Symbol: RPS6KL1
  Gene Name: ribosomal protein S6 kinase-like 1
  ENSP ID: ENSP00000451795
  MOD_RES (1)..(1): Any amino acid
XSVREEQVKQWAAEMLVALEALHEQGVLCRDLHPGNLLLDQAVVRGGAPVLRGGRGQSLQRPRGGWDFRADGSL

SEQ ID NO: 74458 - protein, 48 aa, Homo sapiens
  Payload ID: 14715
  Gene Symbol: RPS6KL1
  Gene Name: ribosomal protein S6 kinase-like 1
  ENSP ID: ENSP00000451986
  MOD_RES (1)..(1): Any amino acid
XAASLLTELLQFEPTRRLGMGEGGVSKLKSHPFFSTIQWSKLVGQQTR

SEQ ID NO: 74459 - protein, 549 aa, Homo sapiens; identical to SEQ ID NO: 74450
  Payload ID: 14715
  Gene Symbol: RPS6KL1
  Gene Name: ribosomal protein S6 kinase-like 1
  Uniprot ID: Q9Y6S9
  ENSP ID: ENSP00000452027

SEQ ID NO: 74460 - protein, 194 aa, Homo sapiens [sequence omitted]

SEQ ID NO: 74461 - protein, 194 aa, Homo sapiens [sequence omitted]

SEQ ID NO: 74462 - protein, 194 aa, Homo sapiens [sequence omitted]

SEQ ID NO: 74463 - protein, 187 aa, Homo sapiens
  Payload ID: 14716
  Gene Symbol: RPS7
  Gene Name: ribosomal protein S7
  ENSP ID: ENSP00000385729
MFSSSAKIVKPNGEKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVIGQHFIMERFSHSESGF

SEQ ID NO: 74464 - protein, 188 aa, Homo sapiens
  Payload ID: 14717
  Gene Symbol: RPS8
  Gene Name: ribosomal protein S8
  ENSP ID: ENSP00000361283
MGISRDNWHKRRKTGGKRKPYHKKRKYELGRPAANTKIGPRRIHTVRVRGGCTRKTRIIDVVYNASNNELVRTKTLVKNCIVLIDSTPYRQWYESHYALPLGRKKGAKLTPEEEEILNKKRSKKIQKKYDERKKNAKISSLLEEQFQQGKLLACIASRPGQCGRADGYVLEGKELEFYLRKIKARKGK

SEQ ID NO: 74465 - protein, 208 aa, Homo sapiens [sequence omitted]

SEQ ID NO: 74466 - protein, 194 aa, Homo sapiens [sequence omitted]

SEQ ID NO: 74467 - protein, 79 aa, Homo sapiens
  Payload ID: 14718
  Gene Symbol: RPS9
  Gene Name: ribosomal protein S9
  ENSP ID: ENSP00000375631
MPVARSWVCRKTYVTPRRPFEKSRLDQELKLIGEYGLRNKREVWRVKFTLAKIRKAARELLTLDEKDPRRLFEGSASRW

SEQ ID NO: 74468 - protein, 194 aa, Homo sapiens [sequence omitted]

SEQ ID NO: 74469 - protein, 194 aa, Homo sapiens [sequence omitted]

SEQ ID NO: 74470 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000383937

SEQ ID NO: 74471 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000391823

SEQ ID NO: 74472 - protein, 77 aa, Homo sapiens
  Payload ID: 14718
  Gene Symbol: RPS9
  Gene Name: ribosomal protein S9
  ENSP ID: ENSP00000399623
MPVARSWVCRKTYVTPRRPFEKSRLDQELKLIGEYGLRNKREVWRVKFTLAKIRKAARELLTLDEKDPRRLFEGGSL

SEQ ID NO: 74473 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000406159

SEQ ID NO: 74474 - protein, 156 aa, Homo sapiens
  Payload ID: 14718
  Gene Symbol: RPS9
  Gene Name: ribosomal protein S9
  ENSP ID: ENSP00000414314
MPVARSWVCRKTYVTPRRPFEKSRLDQELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVLIRQRHIRYHLGWAPESSSTCPSDGCPH

SEQ ID NO: 74475 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000479899

SEQ ID NO: 74476 - protein, 194 aa, Homo sapiens [sequence omitted]

SEQ ID NO: 74477 - protein, 194 aa, Homo sapiens [sequence omitted]

SEQ ID NO: 74478 - protein, 156 aa, Homo sapiens; identical to SEQ ID NO: 74474
  Payload ID: 14718
  Gene Symbol: RPS9
  Gene Name: ribosomal protein S9
  ENSP ID: ENSP00000480805

SEQ ID NO: 74479 - protein, 77 aa, Homo sapiens; identical to SEQ ID NO: 74472
  Payload ID: 14718
  Gene Symbol: RPS9
  Gene Name: ribosomal protein S9
  ENSP ID: ENSP00000480878

SEQ ID NO: 74480 - protein, 194 aa, Homo sapiens [sequence omitted]

SEQ ID NO: 74481 - protein, 194 aa, Homo sapiens [sequence omitted]

SEQ ID NO: 74482 - protein, 194 aa, Homo sapiens [sequence omitted]

SEQ ID NO: 74483 - protein, 194 aa, Homo sapiens [sequence omitted]

SEQ ID NO: 74484 - protein, 79 aa, Homo sapiens; identical to SEQ ID NO: 74467
  Payload ID: 14718
  Gene Symbol: RPS9
  Gene Name: ribosomal protein S9
  ENSP ID: ENSP00000481941

SEQ ID NO: 74485 - protein, 194 aa, Homo sapiens [sequence omitted]

SEQ ID NO: 74486 - protein, 194 aa, Homo sapiens [sequence omitted]

SEQ ID NO: 74487 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000482953

SEQ ID NO: 74488 - protein, 194 aa, Homo sapiens [sequence omitted]

SEQ ID NO: 74489 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000483297

SEQ ID NO: 74490 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000485771

SEQ ID NO: 74491 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000486703

SEQ ID NO: 74492 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000486704

SEQ ID NO: 74493 - protein, 139 aa, Homo sapiens; identical to SEQ ID NO: 1038
  Payload ID: 14718
  Gene Symbol: RPS9
  Gene Name: ribosomal protein S9
  ENSP ID: ENSP00000487085

SEQ ID NO: 74494 - protein, 295 aa, Homo sapiens [sequence omitted]

SEQ ID NO: 74495 - protein, 300 aa, Homo sapiens
  Payload ID: 14719
  Gene Symbol: RPSA
  Gene Name: ribosomal protein SA
  ENSP ID: ENSP00000389351
MSGALDVLQMKEEDVLKFLAAGTHLGGTNLDFQMEQYIYKRKSDGIYIINLKRTWEKLLLAARAIVAIENPADVSVISSRNTGQVCGTVRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTATQPEVADWSEGVQVPSVPIQQFPTEDWSAQPATEDWSAAPTAQATEWVGATTDWS

SEQ ID NO: 74496 - protein, 116 aa, Homo sapiens
  Payload ID: 14719
  Gene Symbol: RPSA
  Gene Name: ribosomal protein SA
  ENSP ID: ENSP00000396716
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAF

SEQ ID NO: 74497 - protein, 263 aa, Homo sapiens
  Payload ID: 14719
  Gene Symbol: RPSA
  Gene Name: ribosomal protein SA
  ENSP ID: ENSP00000410848
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTATQPEVADWSEGVQVPSVPIQQFP

SEQ ID NO: 74498 - protein, 317 aa, Homo sapiens
  Payload ID: 14720
  Gene Symbol: RPLP0
  Gene Name: ribosomal protein, large, P0
  Uniprot ID: P05388
  ENSP ID: ENSP00000339027
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 74499 - protein, 255 aa, Homo sapiens
  Payload ID: 14720
  Gene Symbol: RPLP0
  Gene Name: ribosomal protein, large, P0
  Uniprot ID: P05388
  ENSP ID: ENSP00000366471
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 74500 - protein, 317 aa, Homo sapiens; identical to SEQ ID NO: 74498
  Payload ID: 14720
  Gene Symbol: RPLP0
  Gene Name: ribosomal protein, large, P0
  Uniprot ID: P05388
  ENSP ID: ENSP00000376299

SEQ ID NO: 74501 - protein, 107 aa, Homo sapiens
  Payload ID: 14720
  Gene Symbol: RPLP0
  Gene Name: ribosomal protein, large, P0
  ENSP ID: ENSP00000446777
MKSSLPQGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 74502 - protein, 246 aa, Homo sapiens
  Payload ID: 14720
  Gene Symbol: RPLP0
  Gene Name: ribosomal protein, large, P0
  ENSP ID: ENSP00000447311
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAP

SEQ ID NO: 74503 - protein, 247 aa, Homo sapiens
  Payload ID: 14720
  Gene Symbol: RPLP0
  Gene Name: ribosomal protein, large, P0
  ENSP ID: ENSP00000448046
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKR

SEQ ID NO: 74504 - protein, 121 aa, Homo sapiens
  Payload ID: 14720
  Gene Symbol: RPLP0
  Gene Name: ribosomal protein, large, P0
  ENSP ID: ENSP00000448223
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKLLPVLVPLPHVKSLC

SEQ ID NO: 74505 - protein, 156 aa, Homo sapiens
  Payload ID: 14720
  Gene Symbol: RPLP0
  Gene Name: ribosomal protein, large, P0
  ENSP ID: ENSP00000448639
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGVYCPTIIWFRVMCS

SEQ ID NO: 74506 - protein, 57 aa, Homo sapiens
  Payload ID: 14720
  Gene Symbol: RPLP0
  Gene Name: ribosomal protein, large, P0
  ENSP ID: ENSP00000448919
MPREDRATWKSNYFLKIIVSAGNYWMIIRNVSLWEQTMWAPSRCSRSACPFAGRLWC

SEQ ID NO: 74507 - protein, 281 aa, Homo sapiens
  Payload ID: 14720
  Gene Symbol: RPLP0
  Gene Name: ribosomal protein, large, P0
  ENSP ID: ENSP00000449205
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 74508 - protein, 317 aa, Homo sapiens; identical to SEQ ID NO: 74498
  Payload ID: 14720
  Gene Symbol: RPLP0
  Gene Name: ribosomal protein, large, P0
  Uniprot ID: P05388
  ENSP ID: ENSP00000449328

SEQ ID NO: 74509 - protein, 111 aa, Homo sapiens
  Payload ID: 14720
  Gene Symbol: RPLP0
  Gene Name: ribosomal protein, large, P0
  ENSP ID: ENSP00000449765
MAFEQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPA

SEQ ID NO: 74510 - protein, 244 aa, Homo sapiens
  Payload ID: 14720
  Gene Symbol: RPLP0
  Gene Name: ribosomal protein, large, P0
  ENSP ID: ENSP00000449854
MPREDRATWKSNYFLKIIQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEK

SEQ ID NO: 74511 - protein, 166 aa, Homo sapiens
  Payload ID: 14720
  Gene Symbol: RPLP0
  Gene Name: ribosomal protein, large, P0
  ENSP ID: ENSP00000450019
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILVFTAPLLSGSE

SEQ ID NO: 74512 - protein, 153 aa, Homo sapiens
  Payload ID: 14720
  Gene Symbol: RPLP0
  Gene Name: ribosomal protein, large, P0
  ENSP ID: ENSP00000450121
MAFEQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKV

SEQ ID NO: 74513 - protein, 142 aa, Homo sapiens
  Payload ID: 14720
  Gene Symbol: RPLP0
  Gene Name: ribosomal protein, large, P0
  ENSP ID: ENSP00000450222
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALE

SEQ ID NO: 74514 - protein, 114 aa, Homo sapiens
  Payload ID: 14721
  Gene Symbol: RPLP1
  Gene Name: ribosomal protein, large, P1
  Uniprot ID: P05386
  ENSP ID: ENSP00000346037
MASVSELACIYSALILHDDEVTVTEDKINALIKAAGVNVEPFWPGLFAKALANVNIGSLICNVGAGGPAPAAGAAPAGGPAPSTAAAPAEEKKVEAKKEESEESDDDMGFGLFD

SEQ ID NO: 74515 - protein, 89 aa, Homo sapiens
  Payload ID: 14721
  Gene Symbol: RPLP1
  Gene Name: ribosomal protein, large, P1
  Uniprot ID: P05386
  ENSP ID: ENSP00000350437
MASVSELACIYSALILHDDEVTVTALANVNIGSLICNVGAGGPAPAAGAAPAGGPAPSTAAAPAEEKKVEAKKEESEESDDDMGFGLFD

SEQ ID NO: 74516 - protein, 54 aa, Homo sapiens
  Payload ID: 14721
  Gene Symbol: RPLP1
  Gene Name: ribosomal protein, large, P1
  ENSP ID: ENSP00000453067
MASVSELACIYSALILHDDEVTVTLRRRKWKQRKKNPRSLMMTWALVFLTKPLL

SEQ ID NO: 74517 - protein, 115 aa, Homo sapiens
  Payload ID: 14722
  Gene Symbol: RPLP2
  Gene Name: ribosomal protein, large, P2
  Uniprot ID: P05387
  ENSP ID: ENSP00000322419
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 74518 - protein, 115 aa, Homo sapiens; identical to SEQ ID NO: 74517
  Payload ID: 14722
  Gene Symbol: RPLP2
  Gene Name: ribosomal protein, large, P2
  Uniprot ID: P05387
  ENSP ID: ENSP00000431240

SEQ ID NO: 74519 - protein, 92 aa, Homo sapiens
  Payload ID: 14722
  Gene Symbol: RPLP2
  Gene Name: ribosomal protein, large, P2
  ENSP ID: ENSP00000433443
  MOD_RES (1)..(1): Any amino acid
XGGNSSPSAKDIKKILDSVISELNGKNIEDVIAQGIGKLASVPAGGAVAVSAAPGSAAPAAGSAPAAAEEKKDEKKEESEESDDDMGFGLFD

SEQ ID NO: 74520 - protein, 475 aa, Homo sapiens
  Payload ID: 14723
  Gene Symbol: RRNAD1
  Gene Name: ribosomal RNA adenine dimethylase domain containing 1
  Uniprot ID: Q96FB5
  ENSP ID: ENSP00000357199
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHVAQENRVVAFFSLALLLAPLVETLILLDRLLYLQEQGFHAELLPIFSPELSPRNLVLVATKMPLGQALSVLETEDS

SEQ ID NO: 74521 - protein, 277 aa, Homo sapiens
  Payload ID: 14723
  Gene Symbol: RRNAD1
  Gene Name: ribosomal RNA adenine dimethylase domain containing 1
  Uniprot ID: Q96FB5
  ENSP ID: ENSP00000357201
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQICAAGATASGARSPAATESGCPSGPRGPGEPCGGLLQPGSTACPTGGDAYSTGPAAVPSGTGFPC

SEQ ID NO: 74522 - protein, 100 aa, Homo sapiens
  Payload ID: 14723
  Gene Symbol: RRNAD1
  Gene Name: ribosomal RNA adenine dimethylase domain containing 1
  ENSP ID: ENSP00000429053
MPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQA

SEQ ID NO: 74523 - protein, 94 aa, Homo sapiens
  Payload ID: 14723
  Gene Symbol: RRNAD1
  Gene Name: ribosomal RNA adenine dimethylase domain containing 1
  ENSP ID: ENSP00000429389
MPGISARGLSHEGRKQLAVNLTRVLALYRSILDAYIIVQVSVATHPAGPEVHGVCPGLYPDAWLSDPLRIPGEPQPELPTNSSIPETCQAQEAA

SEQ ID NO: 74524 - protein, 345 aa, Homo sapiens
  Payload ID: 14723
  Gene Symbol: RRNAD1
  Gene Name: ribosomal RNA adenine dimethylase domain containing 1
  ENSP ID: ENSP00000429756
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGEGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPR

SEQ ID NO: 74525 - protein, 139 aa, Homo sapiens
  Payload ID: 14723
  Gene Symbol: RRNAD1
  Gene Name: ribosomal RNA adenine dimethylase domain containing 1
  ENSP ID: ENSP00000429800
  MOD_RES (1)..(1): Any amino acid
XNPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRYVQRGLQRVGLDPQLPLNLAALQAH

SEQ ID NO: 74526 - protein, 154 aa, Homo sapiens
  Payload ID: 14723
  Gene Symbol: RRNAD1
  Gene Name: ribosomal RNA adenine dimethylase domain containing 1
  ENSP ID: ENSP00000430787
MPGFQTPSEFLENPSQSSRLTAPFRKHVRPKKQHEIRRLGEGHLSRFMALGLGLMVKSIEGDQRLVERAQRLDQELLQALEKEEKRNPQICAAGATASGARSPAATESGCPSGPRGPGEPCGGLLQPGSTACPTGGDAYSTGPAAVPSGTGFPC

SEQ ID NO: 74527 - protein, 461 aa, Homo sapiens
  Payload ID: 14724
  Gene Symbol: RRP1
  Gene Name: ribosomal RNA processing 1
  Uniprot ID: P56182
  ENSP ID: ENSP00000417464
MVSRVQLPPEIQLAQRLAGNEQVTRDRAVRKLRKYIVARTQRAAGGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 74528 - protein, 45 aa, Homo sapiens
  Payload ID: 14724
  Gene Symbol: RRP1
  Gene Name: ribosomal RNA processing 1
  ENSP ID: ENSP00000426898
MVSRVQLPPEIQLAQRLAGNEQVTRDRAVRKLRKYIVARTQRAAD

SEQ ID NO: 74529 - protein, 1197 aa, Homo sapiens
  Payload ID: 14725
  Gene Symbol: RRP12
  Gene Name: ribosomal RNA processing 12 homolog
  Uniprot ID: Q5JTH9
  ENSP ID: ENSP00000324315
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 74530 - protein, 1297 aa, Homo sapiens
  Payload ID: 14725
  Gene Symbol: RRP12
  Gene Name: ribosomal RNA processing 12 homolog
  Uniprot ID: Q5JTH9
  ENSP ID: ENSP00000360031
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 74531 - protein, 64 aa, Homo sapiens
  Payload ID: 14725
  Gene Symbol: RRP12
  Gene Name: ribosomal RNA processing 12 homolog
  ENSP ID: ENSP00000401102
MGRSGKLPSGVSAKLKRWKKGHSSDSNPAICRHRQAARSRFFSRPSGRSDLTVDAVKLHNELQS

SEQ ID NO: 74532 - protein, 1236 aa, Homo sapiens
  Payload ID: 14725
  Gene Symbol: RRP12
  Gene Name: ribosomal RNA processing 12 homolog
  Uniprot ID: Q5JTH9
  ENSP ID: ENSP00000414863
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 74533 - protein, 1297 aa, Homo sapiens; identical to SEQ ID NO: 74530
  Payload ID: 14725
  Gene Symbol: RRP12
  Gene Name: ribosomal RNA processing 12 homolog
  Uniprot ID: Q5JTH9
  ENSP ID: ENSP00000446184

SEQ ID NO: 74534 - protein, 32 aa, Homo sapiens
  Payload ID: 14725
  Gene Symbol: RRP12
  Gene Name: ribosomal RNA processing 12 homolog
  ENSP ID: ENSP00000482139
MGRSGKLPSGVSAKLKRWKKGHSSDSNPAICR

SEQ ID NO: 74535 - protein, 106 aa, Homo sapiens
  Payload ID: 14725
  Gene Symbol: RRP12
  Gene Name: ribosomal RNA processing 12 homolog
  ENSP ID: ENSP00000483365
RGKEQRKLARQRSRAWLKEGGGDEPLNFLDPKVAQRVLATQPGPGRGRKKDHGFKVSADGRLIIREEADGNKMEEEEGAKGGPNALVHSFTVFTYSFGDHLLRKRG

SEQ ID NO: 74536 - protein, 176 aa, Homo sapiens
  Payload ID: 14725
  Gene Symbol: RRP12
  Gene Name: ribosomal RNA processing 12 homolog
  ENSP ID: ENSP00000484474
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLK

SEQ ID NO: 74537 - protein, 282 aa, Homo sapiens
  Payload ID: 14726
  Gene Symbol: RRP15
  Gene Name: ribosomal RNA processing 15 homolog
  Uniprot ID: Q9Y3B9
  ENSP ID: ENSP00000355899
MAAAAPDSRVSEEENLKKTPKKKMKMVTGAVASVLEDEATDTSDSEGSCGSEKDHFYSDDDAIEADSEGDAEPCDKENENDGESSVGTNMGWADAMAKVLNKKTPESKPTILVKNKKLEKEKEKLKQERLEKIKQRDKRLEWEMMCRVKPDVVQDKETERNLQRIATRGVVQLFNAVQKHQKNVDEKVKEAGSSMRKRAKLISTVSKKDFISVLRGMDGSTNETASSRKKPKAKQTEVKSEEGPGWTILRDDFMMGASMKDWDKESDGPDDSRPESASDSDT

SEQ ID NO: 74538 - protein, 758 aa, Homo sapiens
  Payload ID: 14727
  Gene Symbol: RRP1B
  Gene Name: ribosomal RNA processing 1B
  Uniprot ID: Q14684
  ENSP ID: ENSP00000339145
MAPAMQPAEIQFAQRLASSEKGIRDRAVKKLRQYISVKTQRETGGFSQEELLKIWKGLFYCMWVQDEPLLQEELANTIAQLVHAVNNSAAQHLFIQTFWQTMNREWKGIDRLRLDKYYMLIRLVLRQSFEVLKRNGWEESRIKVFLDVLMKEVLCPESQSPNGVRFHFIDIYLDELSKVGGKELLADQNLKFIDPFCKIAAKTKDHTLVQTIARGVFEAIVDQSPFVPEETMEEQKTKVGDGDLSAEEIPENEVSLRRAVSKKKTALGKNHSRKDGLSDERGRDDCGTFEDTGPLLQFDYKAVADRLLEMTSRKNTPHFNRKRLSKLIKKFQDLSEGSSISQLSFAEDISADEDDQILSQGKHKKKGNKLLEKTNLEKEKGSRVFCVEEEDSESSLQKRRRKKKKKHHLQPENPGPGGAAPSLEQNRGREPEASGLKALKARVAEPGAEATSSTGEESGSEHPPAVPMHNKRKRPRKKSPRAHREMLESAVLPPEDMSQSGPSGSHPQGPRGSPTGGAQLLKRKRKLGVVPVNGSGLSTPAWPPLQQEGPPTGPAEGANSHTTLPQRRRLQKKKAGPGSLELCGLPSQKTASLKKRKKMRVMSNLVEHNGVLESEAGQPQALGSSGTCSSLKKQKLRAESDFVKFDTPFLPKPLFFRRAKSSTATHPPGPAVQLNKTPSSSKKVTFGLNRNMTAEFKKTDKSILVSPTGPSRVAFDPEQKPLHGVLKTPTSSPASSPLVAKKPLTTTPRRRPRAMDFF

SEQ ID NO: 74539 - protein, 259 aa, Homo sapiens
  Payload ID: 14728
  Gene Symbol: RRP36
  Gene Name: ribosomal RNA processing 36
  Uniprot ID: Q96EU6
  ENSP ID: ENSP00000244496
MPGANYRAGAGAGAGARRPRGARDREEDGGGLEPAAVARDLLRGTSNMSFEELLELQSQVGTKTYKQLVAGNSPKKQASRPPIQNACVADKHRPLEMSAKIRVPFLRQVVPISKKVARDPRFDDLSGEYNPEVFDKTYQFLNDIRAKEKELVKKQLKKHLSGEEHEKLQQLLQRMEQQEMAQQERKQQQELHLALKQERRAQAQQGHRPYFLKKSEQRQLALAEKFKELKRSKKLENFLSRKRRRNAGKDRRHLPLSKE

SEQ ID NO: 74540 - protein, 29 aa, Homo sapiens
  Payload ID: 14728
  Gene Symbol: RRP36
  Gene Name: ribosomal RNA processing 36
  ENSP ID: ENSP00000475391
EYNPEVFDKTYQFLNDIRAKEKELTFAEC

SEQ ID NO: 74541 - protein, 280 aa, Homo sapiens
  Payload ID: 14729
  Gene Symbol: RRP7A
  Gene Name: ribosomal RNA processing 7 homolog A
  Uniprot ID: Q9Y3A4
  ENSP ID: ENSP00000321449
MVARRRKCAARDPEDRIPSPLGYAAIPIKFSEKQQASHYLYVRAHGVRQGTKSTWPQKRTLFVLNVPPYCTEESLSRLLSTCGLVQSVELQEKPDLAESPKESRSKFFHPKPVPGFQVAYVVFQKPSGVSAALALKGPLLVSTESHPVKSGIHKWISDYADSVPDPEALRVEVDTFMEAYDQKIAEEEAKAKEEEGVPDEEGWVKVTRRGRRPVLPRTEAASLRVLERERRKRSRKELLNFYAWQHRESKMEHLAQLRKKFEEDKQRIELLRAQRKFRPY

SEQ ID NO: 74542 - protein, 53 aa, Homo sapiens
  Payload ID: 14729
  Gene Symbol: RRP7A
  Gene Name: ribosomal RNA processing 7 homolog A
  ENSP ID: ENSP00000405547
MVARRRKCAARDPEDRIPSPLGYAASRLLREAVKAQAVGSELAGGAEVMLRLS

SEQ ID NO: 74543 - protein, 456 aa, Homo sapiens
  Payload ID: 14730
  Gene Symbol: RRP8
  Gene Name: ribosomal RNA processing 8, methyltransferase, homolog (yeast)
  Uniprot ID: O43159
  ENSP ID: ENSP00000254605
MFEEPEWAEAAPVAAGLGPVISRPPPAASSQNKGSKRRQLLATLRALEAASLSQHPPSLCISDSEEEEEERKKKCPKKASFASASAEVGKKGKKKCQKQGPPCSDSEEEVERKKKCHKQALVGSDSAEDEKRKRKCQKHAPINSAQHLDNVDQTGPKAWKGSTTNDPPKQSPGSTSPKPPHTLSRKQWRNRQKNKRRCKNKFQPPQVPDQAPAEAPTEKTEVSPVPRTDSHEARAGALRARMAQRLDGARFRYLNEQLYSGPSSAAQRLFQEDPEAFLLYHRGFQSQVKKWPLQPVDRIARDLRQRPASLVVADFGCGDCRLASSIRNPVHCFDLASLDPRVTVCDMAQVPLEDESVDVAVFCLSLMGTNIRDFLEEANRVLKPGGLLKVAEVSSRFEDVRTFLRAVTKLGFKIVSKDLTNSHFFLFDFQKTGPPLVGPKAQLSGLQLQPCLYKRR

SEQ ID NO: 74544 - protein, 78 aa, Homo sapiens
  Payload ID: 14730
  Gene Symbol: RRP8
  Gene Name: ribosomal RNA processing 8, methyltransferase, homolog (yeast)
  ENSP ID: ENSP00000435873
MFEEPEWAEAAPVAAGLGPVISRPPPAASSQNKASSILFRPTVIPCFPPGLQAPPALGHITGPRGSISFPASPQPMYK

SEQ ID NO: 74545 - protein, 306 aa, Homo sapiens
  Payload ID: 14730
  Gene Symbol: RRP8
  Gene Name: ribosomal RNA processing 8, methyltransferase, homolog (yeast)
  ENSP ID: ENSP00000436246
MFEEPEWAEAAPVAAGLGPVISRPPPAASSQNKGSKRRQLLATLRALEAASLSQHPPSLCISDSEEEEEERKKKCPKKASFASASAEVGKKGKKKCQKQGPPCSDSEEEVERKKKCHKQALVGSDSAEDEKRKRKCQKHAPINSAQHLDNVDQTGPKAWKGSTTNDPPKQSPGSTSPKPPHTLSRKQWRNRQKNKRRCKNKFQPPQVPDQAPAEAPTEKTEVSPVPRTDSHEARAGALRARMAQRLDGARFRYLNEQLYSGPSSAAQRLFQEDPEAFLLYHRGFQSQVKKWPLQPVDRIARDLRQR

SEQ ID NO: 74546 - protein, 140 aa, Homo sapiens
  Payload ID: 14730
  Gene Symbol: RRP8
  Gene Name: ribosomal RNA processing 8, methyltransferase, homolog (yeast)
  ENSP ID: ENSP00000436960
MFEEPEWAEAAPVAAGLGPVISRPPPAASSQNKVPLEDESVDVAVFCLSLMGTNIRDFLEEANRVLKPGGLLKVAEVSSRFEDVRTFLRAVTKLGFKIVSKDLTNSHFFLFDFQKTGPPLVGPKAQLSGLQLQPCLYKRR

SEQ ID NO: 74547 - protein, 475 aa, Homo sapiens
  Payload ID: 14731
  Gene Symbol: RRP9
  Gene Name: ribosomal RNA processing 9, small subunit (SSU) processome component, homolog (yeast)
  Uniprot ID: O43818
  ENSP ID: ENSP00000232888
MSATAAARKRGKPASGAGAGAGAGKRRRKADSAGDRGKSKGGGKMNEEISSDSESESLAPRKPEEEEEEELEETAQEKKLRLAKLYLEQLRQQEEEKAEARAFEEDQVAGRLKEDVLEQRGRLQKLVAKEIQAPASADIRVLRGHQLSITCLVVTPDDSAIFSAAKDCSIIKWSVESGRKLHVIPRAKKGAEGKPPGHSSHVLCMAISSDGKYLASGDRSKLILIWEAQSCQHLYTFTGHRDAVSGLAFRRGTHQLYSTSHDRSVKVWNVAENSYVETLFGHQDAVAALDALSRECCVTAGGRDGTVRVWKIPEESQLVFYGHQGSIDCIHLINEEHMVSGADDGSVALWGLSKKRPLALQREAHGLRGEPGLEQPFWISSVAALLNTDLVATGSHSSCVRLWQCGEGFRQLDLLCDIPLVGFINSLKFSSSGDFLVAGVGQEHRLGRWWRIKEARNSVCIIPLRRVPVPPAAGS

SEQ ID NO: 74548 - protein, 242 aa, Homo sapiens
  Payload ID: 14732
  Gene Symbol: RBFA
  Gene Name: ribosome binding factor A (putative)
  Uniprot ID: Q8N0V3
  ENSP ID: ENSP00000262197
MWAAAGGLWRSRAGLRALFRSRDAALFPGCERGLHCSAVSCKNWLKKFASKTKKKVWYESPSLGSHSTYKPSKLEFLMRSTSKKTRKEDHARLRALNGLLYKALTDLLCTPEVSQELYDLNVELSKVSLTPDFSACRAYWKTTLSAEQNAHMEAVLQRSAAHMSLISYWQSQTLDPGMKETTLYKMISGTLMPHNPAAPQSRPQAPVCVGSIMRRSTSRLWSTKGGKIKGSGAWCGRGRWLS

SEQ ID NO: 74549 - protein, 343 aa, Homo sapiens
  Payload ID: 14732
  Gene Symbol: RBFA
  Gene Name: ribosome binding factor A (putative)
  Uniprot ID: Q8N0V3
  ENSP ID: ENSP00000305696
MWAAAGGLWRSRAGLRALFRSRDAALFPGCERGLHCSAVSCKNWLKKFASKTKKKVWYESPSLGSHSTYKPSKLEFLMRSTSKKTRKEDHARLRALNGLLYKALTDLLCTPEVSQELYDLNVELSKVSLTPDFSACRAYWKTTLSAEQNAHMEAVLQRSAAHMRHLLMSQQTLRNVPPIVFVQDKGNAALAELDQLLAVADFGPRDERDNFVQNDFRDPDAPQPCGTTEPTTSSSLCGIDHEALNKQIMEYKRRKDKGLGGLVWQGQVAELTTQMKKGRKRAKPRLEQDSSLKSYLSGEEVEDDLDLVGAPEYECYAPDTEELEAERGGGRTEDGHSCGASRE

SEQ ID NO: 74550 - protein, 1410 aa, Homo sapiens
  Payload ID: 14733
  Gene Symbol: RRBP1
  Gene Name: ribosome binding protein 1
  ENSP ID: ENSP00000246043
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQGKKAEGAQNQGKKAEGAQNQGKKAEGAQNQGKKAEGAQNQGKKAEGAQNQGKKVEGAQNQGKKAEGAQNQGKKAEGAQNQGKKAEGAQNQGKKAEGAQNQGKKAEGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 74551 - protein, 977 aa, Homo sapiens
  Payload ID: 14733
  Gene Symbol: RRBP1
  Gene Name: ribosome binding protein 1
  Uniprot ID: Q9P2E9
  ENSP ID: ENSP00000354045
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEGRNTDVAQSPEAPKQEAPAKKKSGSKKKGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 74552 - protein, 977 aa, Homo sapiens; identical to SEQ ID NO: 74551
  Payload ID: 14733
  Gene Symbol: RRBP1
  Gene Name: ribosome binding protein 1
  Uniprot ID: Q9P2E9
  ENSP ID: ENSP00000367038

SEQ ID NO: 74553 - protein, 1410 aa, Homo sapiens; identical to SEQ ID NO: 74550
  Payload ID: 14733
  Gene Symbol: RRBP1
  Gene Name: ribosome binding protein 1
  ENSP ID: ENSP00000367044

SEQ ID NO: 74554 - protein, 300 aa, Homo sapiens
  Payload ID: 14733
  Gene Symbol: RRBP1
  Gene Name: ribosome binding protein 1
  ENSP ID: ENSP00000381762
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAK

SEQ ID NO: 74555 - protein, 751 aa, Homo sapiens
  Payload ID: 14733
  Gene Symbol: RRBP1
  Gene Name: ribosome binding protein 1
  ENSP ID: ENSP00000401206
MVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 74556 - protein, 229 aa, Homo sapiens
  Payload ID: 14733
  Gene Symbol: RRBP1
  Gene Name: ribosome binding protein 1
  ENSP ID: ENSP00000476483
QGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGRTQSWPSFGRSSARSAKSWWRSQRLCGKMSSSGKLWKPRQLPSRSRSCSCRRPTGRVRRPCRSAWTRSAGSCATRRAATPASGRMPRRPRSNSSRWPSCTASYSPPRRRCAANARS

SEQ ID NO: 74557 - protein, 346 aa, Homo sapiens
  Payload ID: 14733
  Gene Symbol: RRBP1
  Gene Name: ribosome binding protein 1
  ENSP ID: ENSP00000478324
MEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKEDGSSSKEGTSV

SEQ ID NO: 74558 - protein, 934 aa, Homo sapiens
  Payload ID: 14733
  Gene Symbol: RRBP1
  Gene Name: ribosome binding protein 1
  ENSP ID: ENSP00000479709
MVVVPPVGAKGNTPATGTTQGKKAEGTQNQSKKAEGAPNQGRKAEGTPNQGKKTEGTPNQGKKAEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 74559 - protein, 365 aa, Homo sapiens
  Payload ID: 14734
  Gene Symbol: RRS1
  Gene Name: ribosome biogenesis regulator homolog
  Uniprot ID: Q15050
  ENSP ID: ENSP00000322396
MEGQSVEELLAKAEQDEAEKLQRITVHKELELQFDLGNLLASDRNPPTGLRCAGPTPEAELQALARDNTQLLINQLWQLPTERVEEAIVARLPEPTTRLPREKPLPRPRPLTRWQQFARLKGIRPKKKTNLVWDEVSGQWRRRWGYQRARDDTKEWLIEVPGNADPLEDQFAKRIQAKKERVAKNELNRLRNLARAHKMQLPSAAGLHPTGHQSKEELGRAMQVAKVSTASVGRFQERLPKEKVPRGSGKKRKFQPLFGDFAAEKKNQLELLRVMNSKKPQLDVTRATNKQMREEDQEEAAKRRKMSQKGKRKGGRQGPGGKRKGGPPSQGGKRKGGLGGKMNSGPPGLGGKRKGGQRPGGKRRK

SEQ ID NO: 74560 - protein, 349 aa, Homo sapiens
  Payload ID: 14735
  Gene Symbol: RPF1
  Gene Name: ribosome production factor 1 homolog
  Uniprot ID: Q9H9Y2
  ENSP ID: ENSP00000359688
MAKAGDKSSSSGKKSLKRKAAAEELQEAAGAGDGATENGVQPPKAAAFPPGFSISEIKNKQRRHLMFTRWKQQQRKEKLAAKKKLKKEREALGDKAPPKPVPKTIDNQRVYDETTVDPNDEEVAYDEATDEFASYFNKQTSPKILITTSDRPHGRTVRLCEQLSTVIPNSHVYYRRGLALKKIIPQCIARDFTDLIVINEDRKTPNGLILSHLPNGPTAHFKMSSVRLRKEIKRRGKDPTEHIPEIILNNFTTRLGHSIGRMFASLFPHNPQFIGRQVATFHNQRDYIFFRFHRYIFRSEKKVGIQELGPRFTLKLRSLQKGTFDSKYGEYEWVHKPREMDTSRRKFHL

SEQ ID NO: 74561 - protein, 129 aa, Homo sapiens
  Payload ID: 14735
  Gene Symbol: RPF1
  Gene Name: ribosome production factor 1 homolog
  ENSP ID: ENSP00000359690
MAKAGDKSSSSGKKSLKRKAAAEELQEAAGAGDGATENGVQPPKAAAFPPGFSISEIKNKQRRHLMFTRWKQQQRKEKLAAKKKLKKEREALGDKAPPKPVPKTIDNQRVYDETTVDPNDEEVMLEVLN

SEQ ID NO: 74562 - protein, 76 aa, Homo sapiens
  Payload ID: 14736
  Gene Symbol: RPF2
  Gene Name: ribosome production factor 2 homolog
  ENSP ID: ENSP00000357857
MDTLDRVVKPKTKRAKRFLEKREPKLNENIKNAMLIKGGNANATVTKVLKDVNVFCFESYKFCFTVCTEKTIRCTI

SEQ ID NO: 74563 - protein, 306 aa, Homo sapiens
  Payload ID: 14736
  Gene Symbol: RPF2
  Gene Name: ribosome production factor 2 homolog
  Uniprot ID: Q9H7B2
  ENSP ID: ENSP00000402338
MDTLDRVVKPKTKRAKRFLEKREPKLNENIKNAMLIKGGNANATVTKVLKDVYALKKPYGVLYKKKNITRPFEDQTSLEFFSKKSDCSLFMFGSHNKKRPNNLVIGRMYDYHVLDMIELGIENFVSLKDIKNSKCPEGTKPMLIFAGDDFDVTEDYRRLKSLLIDFFRGPTVSNIRLAGLEYVLHFTALNGKIYFRSYKLLLKKSGCRTPRIELEEMGPSLDLVLRRTHLASDDLYKLSMKMPKALKPKKKKNISHDTFGTTYGRIHMQKQDLSKLQTRKMKGLKKRPAERITEDHEKKSKRIKKN

SEQ ID NO: 74564 - protein, 214 aa, Homo sapiens
  Payload ID: 14736
  Gene Symbol: RPF2
  Gene Name: ribosome production factor 2 homolog
  ENSP ID: ENSP00000414026
MLIKGGNANATVTKVLKDVYALKKPYGVLYKKKNITRPFEDQTSLEFFSKKSDCSLFMFGSHNKKRPNNLVIGRMYDYHVLDMIELGIENFVSLKDIKNSKCPEGTKPMLIFAGDDFDVTEDYRRLKSLLIDFFRGPTVSNIRLAGLEYVLHFTALNGKIYFRSYKLLLKKSGCRTPRIELEEMGPSLDLVLRRTHLASDDLYKLSMKMPKALK

SEQ ID NO: 74565 - protein, 59 aa, Homo sapiens
  Payload ID: 14736
  Gene Symbol: RPF2
  Gene Name: ribosome production factor 2 homolog
  ENSP ID: ENSP00000476081
MDTLDRVVKPKTKRAKRFLEKREPKLNENIKNAMLIKGGNANATVTKVLKDVEKYYKTF

SEQ ID NO: 74566 - protein, 199 aa, Homo sapiens
  Payload ID: 14737
  Gene Symbol: RPE
  Gene Name: ribulose-5-phosphate-3-epimerase
  Uniprot ID: Q96AT9
  ENSP ID: ENSP00000346501
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKAGANMIVSGSAIMRSEDPRSVINLLRNVCSEAAQKRSLDR

SEQ ID NO: 74567 - protein, 228 aa, Homo sapiens
  Payload ID: 14737
  Gene Symbol: RPE
  Gene Name: ribulose-5-phosphate-3-epimerase
  Uniprot ID: Q96AT9
  ENSP ID: ENSP00000352401
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 74568 - protein, 159 aa, Homo sapiens
  Payload ID: 14737
  Gene Symbol: RPE
  Gene Name: ribulose-5-phosphate-3-epimerase
  ENSP ID: ENSP00000386194
MHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLD

SEQ ID NO: 74569 - protein, 160 aa, Homo sapiens
  Payload ID: 14737
  Gene Symbol: RPE
  Gene Name: ribulose-5-phosphate-3-epimerase
  Uniprot ID: Q96AT9
  ENSP ID: ENSP00000389411
MHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 74570 - protein, 141 aa, Homo sapiens
  Payload ID: 14737
  Gene Symbol: RPE
  Gene Name: ribulose-5-phosphate-3-epimerase
  ENSP ID: ENSP00000392279
MHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEPFGRSLSFTALEVRNFSKIRN

SEQ ID NO: 74571 - protein, 178 aa, Homo sapiens
  Payload ID: 14737
  Gene Symbol: RPE
  Gene Name: ribulose-5-phosphate-3-epimerase
  Uniprot ID: Q96AT9
  ENSP ID: ENSP00000394455
MHMMVSKPEQWVKPMAVAGANQYTFHLEATENPGALIKDIRENGMKSCSVTQAEVQWHSQGPLQVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 74572 - protein, 147 aa, Homo sapiens
  Payload ID: 14737
  Gene Symbol: RPE
  Gene Name: ribulose-5-phosphate-3-epimerase
  ENSP ID: ENSP00000397674
MHMMVSKPEQWVKPMAVAGANQYTFHLEATENPGALIKDIRENGMKSCSVTQAEVQWHSQGPLQVGLAIKPGTSVEYLAPWANQIDMALVMTVEPGFGGQKFMEDMMPKVHWLRTQFPSLDIEVDGGVGPDTVHKCAEIGVQWRDLC

SEQ ID NO: 74573 - protein, 225 aa, Homo sapiens
  Payload ID: 14737
  Gene Symbol: RPE
  Gene Name: ribulose-5-phosphate-3-epimerase
  ENSP ID: ENSP00000400449
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEIGVQWRDLCSLQSLPAGFKRFSCLSLLSSWDYRQELT

SEQ ID NO: 74574 - protein, 178 aa, Homo sapiens; identical to SEQ ID NO: 74571
  Payload ID: 14737
  Gene Symbol: RPE
  Gene Name: ribulose-5-phosphate-3-epimerase
  Uniprot ID: Q96AT9
  ENSP ID: ENSP00000401838

SEQ ID NO: 74575 - protein, 160 aa, Homo sapiens; identical to SEQ ID NO: 74569
  Payload ID: 14737
  Gene Symbol: RPE
  Gene Name: ribulose-5-phosphate-3-epimerase
  Uniprot ID: Q96AT9
  ENSP ID: ENSP00000402061

SEQ ID NO: 74576 - protein, 178 aa, Homo sapiens; identical to SEQ ID NO: 74571
  Payload ID: 14737
  Gene Symbol: RPE
  Gene Name: ribulose-5-phosphate-3-epimerase
  Uniprot ID: Q96AT9
  ENSP ID: ENSP00000403808

SEQ ID NO: 74577 - protein, 157 aa, Homo sapiens
  Payload ID: 14737
  Gene Symbol: RPE
  Gene Name: ribulose-5-phosphate-3-epimerase
  ENSP ID: ENSP00000405695
MHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEIGVQWRDLCSLQSLPAGFKRFSCLSLLSSWDYRQELT

SEQ ID NO: 74578 - protein, 191 aa, Homo sapiens
  Payload ID: 14737
  Gene Symbol: RPE
  Gene Name: ribulose-5-phosphate-3-epimerase
  ENSP ID: ENSP00000411186
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEELT

SEQ ID NO: 74579 - protein, 60 aa, Homo sapiens
  Payload ID: 14737
  Gene Symbol: RPE
  Gene Name: ribulose-5-phosphate-3-epimerase
  ENSP ID: ENSP00000411405
MASGCKIGPSILNSDLANLGAECLRMLDSGADYLHLDAPCSSGRSVFCILFPTSPLVTLW

SEQ ID NO: 74580 - protein, 94 aa, Homo sapiens
  Payload ID: 14737
  Gene Symbol: RPE
  Gene Name: ribulose-5-phosphate-3-epimerase
  ENSP ID: ENSP00000412245
MHMMVSKPEQWVKPMAVAGANQYTFHLEATENPGALIKDIRENGMKSCSVTQAEVQWHSQGPLQVGLAIKPGTSVEYLAPWANQIDMALVMTVE

SEQ ID NO: 74581 - protein, 107 aa, Homo sapiens
  Payload ID: 14737
  Gene Symbol: RPE
  Gene Name: ribulose-5-phosphate-3-epimerase
  ENSP ID: ENSP00000416805
MHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVD

SEQ ID NO: 74582 - protein, 228 aa, Homo sapiens
  Payload ID: 14738
  Gene Symbol: RPEL1
  Gene Name: ribulose-5-phosphate-3-epimerase-like 1
  Uniprot ID: Q2QD12
  ENSP ID: ENSP00000476672
MASGCKIGPSILNSDLANLGAKCLQMLDSGADYLHLDVMDGHFVPNITFGHPVVESLRKQLGQDPFFDMHMMVSKPEQWVKPMAVAEANQYTFHLEATENPGTLIKDIRENGMKVGLAIKPGTSVEYLAPWANQIDMALVMTVEPGFGEQKFMEDMMPKVHWLRTQFPSLDIEGDGGVGSDTVHKCAEAGANMTVSGSAIMRSEDPRSVINLLRNICSEAAQKRSLDR

SEQ ID NO: 74583 - protein, 1165 aa, Homo sapiens
  Payload ID: 14739
  Gene Symbol: RIC1
  Gene Name: RIC1 homolog, RAB6A GEF complex partner 1
  Uniprot ID: Q4ADV7
  ENSP ID: ENSP00000251879
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTGNVDFMSLVQGELYFTPCIYTFCY

SEQ ID NO: 74584 - protein, 1386 aa, Homo sapiens
  Payload ID: 14739
  Gene Symbol: RIC1
  Gene Name: RIC1 homolog, RAB6A GEF complex partner 1
  Uniprot ID: Q4ADV7
  ENSP ID: ENSP00000402240
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIREQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 74585 - protein, 1423 aa, Homo sapiens
  Payload ID: 14739
  Gene Symbol: RIC1
  Gene Name: RIC1 homolog, RAB6A GEF complex partner 1
  Uniprot ID: Q4ADV7
  ENSP ID: ENSP00000416696
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 74586 - protein, 147 aa, Homo sapiens
  Payload ID: 14739
  Gene Symbol: RIC1
  Gene Name: RIC1 homolog, RAB6A GEF complex partner 1
  ENSP ID: ENSP00000438005
HEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDW

SEQ ID NO: 74587 - protein, 1315 aa, Homo sapiens
  Payload ID: 14739
  Gene Symbol: RIC1
  Gene Name: RIC1 homolog, RAB6A GEF complex partner 1
  ENSP ID: ENSP00000439488
  MOD_RES (1)..(1): Any amino acid
XEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIREQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 74588 - protein, 163 aa, Homo sapiens
  Payload ID: 14739
  Gene Symbol: RIC1
  Gene Name: RIC1 homolog, RAB6A GEF complex partner 1
  ENSP ID: ENSP00000442632
  MOD_RES (1)..(1): Any amino acid
XAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQMEQRQ

SEQ ID NO: 74589 - protein, 369 aa, Homo sapiens
  Payload ID: 14740
  Gene Symbol: RIC3
  Gene Name: RIC3 acetylcholine receptor chaperone
  Uniprot ID: Q7Z5B4
  ENSP ID: ENSP00000308820
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGESRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 74590 - protein, 187 aa, Homo sapiens
  Payload ID: 14740
  Gene Symbol: RIC3
  Gene Name: RIC3 acetylcholine receptor chaperone
  Uniprot ID: Q7Z5B4
  ENSP ID: ENSP00000333988
MAYSTVQRVALASGLVLALSLLLPKAFLSRGKRQEPPPTPEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 74591 - protein, 368 aa, Homo sapiens
  Payload ID: 14740
  Gene Symbol: RIC3
  Gene Name: RIC3 acetylcholine receptor chaperone
  Uniprot ID: Q7Z5B4
  ENSP ID: ENSP00000344904
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGERAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 74592 - protein, 288 aa, Homo sapiens
  Payload ID: 14740
  Gene Symbol: RIC3
  Gene Name: RIC3 acetylcholine receptor chaperone
  Uniprot ID: Q7Z5B4
  ENSP ID: ENSP00000395320
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKISYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 74593 - protein, 128 aa, Homo sapiens
  Payload ID: 14740
  Gene Symbol: RIC3
  Gene Name: RIC3 acetylcholine receptor chaperone
  Uniprot ID: Q7Z5B4
  ENSP ID: ENSP00000404415
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKVSRIILIILHQ

SEQ ID NO: 74594 - protein, 328 aa, Homo sapiens
  Payload ID: 14740
  Gene Symbol: RIC3
  Gene Name: RIC3 acetylcholine receptor chaperone
  ENSP ID: ENSP00000431658
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGESTQTDHSDVYVHCLGVFTTKWLDCLIFLSRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKP

SEQ ID NO: 74595 - protein, 45 aa, Homo sapiens
  Payload ID: 14740
  Gene Symbol: RIC3
  Gene Name: RIC3 acetylcholine receptor chaperone
  ENSP ID: ENSP00000434787
MAYSTVQRVALASGLVLALSLLLPKAFLSRGKRQEPPPTPEEHRL

SEQ ID NO: 74596 - protein, 43 aa, Homo sapiens
  Payload ID: 14740
  Gene Symbol: RIC3
  Gene Name: RIC3 acetylcholine receptor chaperone
  ENSP ID: ENSP00000435244
MAYSTVQRVALASGLVLALSLLLPKAFLSRGKRQEPPPTPEEN

SEQ ID NO: 74597 - protein, 537 aa, Homo sapiens
  Payload ID: 14741
  Gene Symbol: RIC8A
  Gene Name: RIC8 guanine nucleotide exchange factor A
  Uniprot ID: Q9NPQ8
  ENSP ID: ENSP00000325941
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQGWPPPQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 74598 - protein, 147 aa, Homo sapiens
  Payload ID: 14741
  Gene Symbol: RIC8A
  Gene Name: RIC8 guanine nucleotide exchange factor A
  ENSP ID: ENSP00000431163
  MOD_RES (1)..(1): Any amino acid
XAAGLLAARGLMAGGRPEGQYSEDEDTDTDEYKEAKASINPVTGRVEEKPPNPMEGMTEEQKEHEAMKLVTMFDKLSRMPCARLWSSSSPRTLTRTLTEDGSSSAPPSGLVLLPETSLGLQPGEATSHWIHTRPHFSILETPSLDSR

SEQ ID NO: 74599 - protein, 531 aa, Homo sapiens
  Payload ID: 14741
  Gene Symbol: RIC8A
  Gene Name: RIC8 guanine nucleotide exchange factor A
  Uniprot ID: Q9NPQ8
  ENSP ID: ENSP00000432008
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 74600 - protein, 44 aa, Homo sapiens
  Payload ID: 14741
  Gene Symbol: RIC8A
  Gene Name: RIC8 guanine nucleotide exchange factor A
  ENSP ID: ENSP00000433009
MDVVLESLKCLCNLVLSSPVAQMLAAEARLVVKLTERVGLYRER

SEQ ID NO: 74601 - protein, 183 aa, Homo sapiens
  Payload ID: 14741
  Gene Symbol: RIC8A
  Gene Name: RIC8 guanine nucleotide exchange factor A
  ENSP ID: ENSP00000433968
MEPRAVAEAVETGEEDVIMEALRSYNQEFSLQHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVR

SEQ ID NO: 74602 - protein, 525 aa, Homo sapiens
  Payload ID: 14741
  Gene Symbol: RIC8A
  Gene Name: RIC8 guanine nucleotide exchange factor A
  Uniprot ID: Q9NPQ8
  ENSP ID: ENSP00000434833
MMPNRRTGRWVLAQGVKGQGRVAPGRRAWWSRSSPCPQRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 74603 - protein, 147 aa, Homo sapiens
  Payload ID: 14741
  Gene Symbol: RIC8A
  Gene Name: RIC8 guanine nucleotide exchange factor A
  ENSP ID: ENSP00000434896
  MOD_RES (1)..(1): Any amino acid
XEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSSPTAPFPNRNRVIQPMGMSPRGHLTSLQDAMCETMEQQLSSDPDSDPD

SEQ ID NO: 74604 - protein, 52 aa, Homo sapiens
  Payload ID: 14741
  Gene Symbol: RIC8A
  Gene Name: RIC8 guanine nucleotide exchange factor A
  ENSP ID: ENSP00000435167
MEPRAVAEAVETGEEDVIMEALRSYNQEWLLPELEANRPPASADADPTPLWI

SEQ ID NO: 74605 - protein, 286 aa, Homo sapiens
  Payload ID: 14741
  Gene Symbol: RIC8A
  Gene Name: RIC8 guanine nucleotide exchange factor A
  ENSP ID: ENSP00000436192
  MOD_RES (1)..(1): Any amino acid
XCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEHYPESPRKTPGDQEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRV

SEQ ID NO: 74606 - protein, 148 aa, Homo sapiens
  Payload ID: 14741
  Gene Symbol: RIC8A
  Gene Name: RIC8 guanine nucleotide exchange factor A
  ENSP ID: ENSP00000436610
MEPRAVAEAVETGEEDVIMEALRSYNQEHSQSFTFDDAQQEDRKSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLT

SEQ ID NO: 74607 - protein, 52 aa, Homo sapiens; identical to SEQ ID NO: 74604
  Payload ID: 14741
  Gene Symbol: RIC8A
  Gene Name: RIC8 guanine nucleotide exchange factor A
  ENSP ID: ENSP00000487470

SEQ ID NO: 74608 - protein, 496 aa, Homo sapiens
  Payload ID: 14742
  Gene Symbol: RIC8B
  Gene Name: RIC8 guanine nucleotide exchange factor B
  Uniprot ID: Q9NVN3
  ENSP ID: ENSP00000347662
MLASKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSRRADVKDLHQDGG

SEQ ID NO: 74609 - protein, 560 aa, Homo sapiens
  Payload ID: 14742
  Gene Symbol: RIC8B
  Gene Name: RIC8 guanine nucleotide exchange factor B
  ENSP ID: ENSP00000376582
MDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSREELLKPMGLKPDGTITPLEEALNQYSVIEETSSDTD

SEQ ID NO: 74610 - protein, 520 aa, Homo sapiens
  Payload ID: 14742
  Gene Symbol: RIC8B
  Gene Name: RIC8 guanine nucleotide exchange factor B
  Uniprot ID: Q9NVN3
  ENSP ID: ENSP00000376583
MDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPKEELLKPMGLKPDGTITPLEEALNQYSVIEETSSDTD

SEQ ID NO: 74611 - protein, 536 aa, Homo sapiens
  Payload ID: 14742
  Gene Symbol: RIC8B
  Gene Name: RIC8 guanine nucleotide exchange factor B
  Uniprot ID: Q9NVN3
  ENSP ID: ENSP00000435301
MDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSRRADVKDLHQDGG

SEQ ID NO: 74612 - protein, 258 aa, Homo sapiens
  Payload ID: 14742
  Gene Symbol: RIC8B
  Gene Name: RIC8 guanine nucleotide exchange factor B
  Uniprot ID: Q9NVN3
  ENSP ID: ENSP00000436359
MLSKLEKSDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNSIEFEERSHLSRGK

SEQ ID NO: 74613 - protein, 276 aa, Homo sapiens
  Payload ID: 14742
  Gene Symbol: RIC8B
  Gene Name: RIC8 guanine nucleotide exchange factor B
  ENSP ID: ENSP00000447701
  MOD_RES (1)..(1): Any amino acid
XASGGARRLPGGSGLGAQSGRGSPAPAAMDEERALYIVRAGEAGAIERVLRDYSDKHRATFKFESTDEDKRKSDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGL

SEQ ID NO: 74614 - protein, 41 aa, Homo sapiens
  Payload ID: 14742
  Gene Symbol: RIC8B
  Gene Name: RIC8 guanine nucleotide exchange factor B
  ENSP ID: ENSP00000447801
MDEERALYIVRAGEAGAIERVLRDYSDKSVYRVDGIILPIL

SEQ ID NO: 74615 - protein, 118 aa, Homo sapiens
  Payload ID: 14742
  Gene Symbol: RIC8B
  Gene Name: RIC8 guanine nucleotide exchange factor B
  ENSP ID: ENSP00000448743
MDEERALYIVRAGEAGAIERVLRDYSDKKLCEGIFKVLIKDIPTTCQVSCLEVLRILSRDKKVLVPVTTKENMQILLRLAKLNELDDSLEKVSEFPVIVESLKCLCNIVFNSQMAQQL

SEQ ID NO: 74616 - protein, 30 aa, Homo sapiens
  Payload ID: 14742
  Gene Symbol: RIC8B
  Gene Name: RIC8 guanine nucleotide exchange factor B
  ENSP ID: ENSP00000450396
MGLKPDGTITPLEEALNQYSVIEETSSDTD

SEQ ID NO: 74617 - protein, 46 aa, Homo sapiens
  Payload ID: 14742
  Gene Symbol: RIC8B
  Gene Name: RIC8 guanine nucleotide exchange factor B
  ENSP ID: ENSP00000464118
  MOD_RES (1)..(1): Any amino acid
XINLITGHLEEPMPNPIDEMTEEQKEYEAMKLVNMLDKLSRGIHIF

SEQ ID NO: 74618 - protein, 157 aa, Homo sapiens
  Payload ID: 14743
  Gene Symbol: RFESD
  Gene Name: Rieske (Fe-S) domain containing
  Uniprot ID: Q8TAC1
  ENSP ID: ENSP00000309229
MNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQRIHTVTVDNGNIYVTLSNEPFKCDSDFYATGDFKVIKSSS

SEQ ID NO: 74619 - protein, 210 aa, Homo sapiens
  Payload ID: 14743
  Gene Symbol: RFESD
  Gene Name: Rieske (Fe-S) domain containing
  Uniprot ID: Q8TAC1
  ENSP ID: ENSP00000369341
MLKCFRNCLRPSSLSTLPLQYGILFPKLLACLVHLHFGHFSSAVISVTSFYLSMNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQRIHTVTVDNGNIYVTLSNEPFKCDSDFYATGDFKVIKSSS

SEQ ID NO: 74620 - protein, 210 aa, Homo sapiens; identical to SEQ ID NO: 74619
  Payload ID: 14743
  Gene Symbol: RFESD
  Gene Name: Rieske (Fe-S) domain containing
  Uniprot ID: Q8TAC1
  ENSP ID: ENSP00000413592

SEQ ID NO: 74621 - protein, 118 aa, Homo sapiens
  Payload ID: 14743
  Gene Symbol: RFESD
  Gene Name: Rieske (Fe-S) domain containing
  ENSP ID: ENSP00000422520
MNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQR

SEQ ID NO: 74622 - protein, 60 aa, Homo sapiens
  Payload ID: 14743
  Gene Symbol: RFESD
  Gene Name: Rieske (Fe-S) domain containing
  ENSP ID: ENSP00000425632
MNLDGSAQDPEKREYSSVCVGREDDIKKSERMTAVVHDREVVIFYHKGEYHAMDIRCYRF

SEQ ID NO: 74623 - protein, 1052 aa, Homo sapiens
  Payload ID: 14744
  Gene Symbol: RIMBP2
  Gene Name: RIMS binding protein 2
  Uniprot ID: O15034
  ENSP ID: ENSP00000261655
MREAAERRQQLQLEHDQALAVLSAKQQEIDLLQKSKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQPHCCHGDEYHTESSRGSDLSDIMEEDEEELYSEMQLEDGGRRRPSGTSHNALKILGNPASAGRVDHMGRRFPRGSAGPQRSRPVTVPSIDDYGRDRLSPDFYEESETDPGAEELPARIFVALFDYDPLTMSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDDVEVYLSDAPSHYSQDTPMRSKAKRKKSVHFTP

SEQ ID NO: 74624 - protein, 157 aa, Homo sapiens
  Payload ID: 14744
  Gene Symbol: RIMBP2
  Gene Name: RIMS binding protein 2
  ENSP ID: ENSP00000439030
MSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDD

SEQ ID NO: 74625 - protein, 645 aa, Homo sapiens
  Payload ID: 14744
  Gene Symbol: RIMBP2
  Gene Name: RIMS binding protein 2
  Uniprot ID: O15034
  ENSP ID: ENSP00000439159
MNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQMVS

SEQ ID NO: 74626 - protein, 62 aa, Homo sapiens
  Payload ID: 14744
  Gene Symbol: RIMBP2
  Gene Name: RIMS binding protein 2
  ENSP ID: ENSP00000439437
  MOD_RES (1)..(1): Any amino acid
XREAGEVAGVIRYRRGEWWPCMTTTPEKARPTSMSRPNLHFAQEILLQFLVKLMKMDFIMGS

SEQ ID NO: 74627 - protein, 645 aa, Homo sapiens; identical to SEQ ID NO: 74625
  Payload ID: 14744
  Gene Symbol: RIMBP2
  Gene Name: RIMS binding protein 2
  Uniprot ID: O15034
  ENSP ID: ENSP00000440347

SEQ ID NO: 74628 - protein, 1639 aa, Homo sapiens
  Payload ID: 14745
  Gene Symbol: RIMBP3
  Gene Name: RIMS binding protein 3
  Uniprot ID: Q9UFD9
  ENSP ID: ENSP00000483386
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQAENKQLRRAGCPYQADEKVKRLKVKRAELTGLARRLADRARKLQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGAQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELEDGRRGLVPSNFVEQIPDSYIPGCLPAKSPDLGPSQLPAGQDEALEEDSLLSGKAQGVVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRARVEVRLPRDLLQVYWGTMSSTVTFDTLLAGPPYPPLDVLVERHASPGVLVVSWLPVTIDSAGSSNGVQVTGYAVYADGLKVCEVADATAGSTLLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCSQHMGTSKSPAPGFIHLRTECGPRKEPCQEKAALERVLRQKQDAQGFTPPQLGASQQYASDFHNVLKEEQEALCLDLWGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGNLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 74629 - protein, 1639 aa, Homo sapiens
  Payload ID: 14746
  Gene Symbol: RIMBP3B
  Gene Name: RIMS binding protein 3B
  Uniprot ID: A6NNM3
  ENSP ID: ENSP00000479326
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLEVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 74630 - protein, 1545 aa, Homo sapiens
  Payload ID: 14747
  Gene Symbol: RIMBP3C
  Gene Name: RIMS binding protein 3C
  ENSP ID: ENSP00000350885
MQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLDVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLIIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 74631 - protein, 1639 aa, Homo sapiens
  Payload ID: 14747
  Gene Symbol: RIMBP3C
  Gene Name: RIMS binding protein 3C
  Uniprot ID: A6NJZ7
  ENSP ID: ENSP00000390630
MAKDSPSPLGASPKKPGCSSPAAAVLENQRRELEKLRAELEAERAGWRAERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLDVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLIIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 74632 - protein, 1133 aa, Homo sapiens
  Payload ID: 14748
  Gene Symbol: RC3H1
  Gene Name: ring finger and CCCH-type domains 1
  Uniprot ID: Q5TC82
  ENSP ID: ENSP00000258349
MPVQAPQWTDFLSCPICTQTFDETIRKPISLGCGHTVCKMCLNKLHRKACPFDQTTINTDIELLPVNSALLQLVGAQVPEQQPITLCSGVEDTKHYEEAKKCVEELALYLKPLSSARGVGLNSTTQSVLSRPMQRKLVTLVHCQLVEEEGRIRAMRAARSLGERTVTELILQHQNPQQLSSNLWAAVRARGCQFLGPAMQEEALKLVLLALEDGSALSRKVLVLFVVQRLEPRFPQASKTSIGHVVQLLYRASCFKVTKRDEDSSLMQLKEEFRTYEALRREHDSQIVQIAMEAGLRIAPDQWSSLLYGDQSHKSHMQSIIDKLQTPASFAQSVQELTIALQRTGDPANLNRLRPHLELLANIDPSPDAPPPTWEQLENGLVAVRTVVHGLVDYIQNHSKKGADQQQPPQHSKYKTYMCRDMKQRGGCPRGASCTFAHSQEELEKFRKMNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPIYPSHYDGRRVYPAPSYTREEIFRESPIPIEIPPAAVPSYVPESRERYQQIESYYPVAPHPTQIRPSYLREPPYSRLPPPPQPHPSLDELHRRRKEIMAQLEERKVISPPPFAPSPTLPPTFHPEEFLDEDLKVAGKYKGNDYSQYSPWSCDTIGSYIGTKDAKPKDVVAAGSVEMMNVESKGMRDQRLDLQRRAAETSDDDLIPFGDRPTVSRFGAISRTSKTIYQGAGPMQAMAPQGAPTKSINISDYSPYGTHGGWGASPYSPHQNIPSQGHFSERERISMSEVASHGKPLPSAEREQLRLELQQLNHQISQQTQLRGLEAVSNRLVLQREANTLAGQSQPPPPPPPKWPGMISSEQLSLELHQVEREIGKRTRELSMENQCSLDMKSKLNTSKQAENGQPEPQNKVPAEDLTLTFSDVPNGSALTQENISLLSNKTSSLNLSEDPEGGGDNNDSQRSGVTPSSAP

SEQ ID NO: 74633 - protein, 1125 aa, Homo sapiens
  Payload ID: 14748
  Gene Symbol: RC3H1
  Gene Name: ring finger and CCCH-type domains 1
  Uniprot ID: Q5TC82
  ENSP ID: ENSP00000356667
MPVQAPQWTDFLSCPICTQTFDETIRKPISLGCGHTVCKMCLNKLHRKACPFDQTTINTDIELLPVNSALLQLVGAQVPEQQPITLCSGVEDTKHYEEAKKCVEELALYLKPLSSARGVGLNSTTQSVLSRPMQRKLVTLVHCQLVEEEGRIRAMRAARSLGERTVTELILQHQNPQQLSSNLWAAVRARGCQFLGPAMQEEALKLVLLALEDGSALSRKVLVLFVVQRLEPRFPQASKTSIGHVVQLLYRASCFKVTKRDEDSSLMQLKEEFRTYEALRREHDSQIVQIAMEAGLRIAPDQWSSLLYGDQSHKSHMQSIIDKLQTPASFAQSVQELTIALQRTGDPANLNRLRPHLELLANIDPSPDAPPPTWEQLENGLVAVRTVVHGLVDYIQNHSKKGADQQQPPQHSKYKTYMCRDMKQRGGCPRGASCTFAHSQEELEKFRKMNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPIYPSHYDGRRVYPAPSYTREEIFRESPIPIEIPPAAVPSYVPESRERYQQIESYYPVAPHPTQIRPSYLREPPYSRLPPPPQPHPSLDELHRRRKEIMAQLEERKVISPPPFAPSPTLPPTFHPEEFLDEDLKVAGKYKGNDYSQYSPWSCDTIGSYIGTKDAKPKDVVAAGSVEMMNVESKGMRDQRLDLQRRAAETSDDDLIPFGDRPTVSRFGAISRTSKTIYQGAGPMQAMAPQGAPTKSINISDYSPYGTHGGWGASPYSPHQNIPSQGHFSERERISMSEVASHGKPLPSAEREQLRLELQQLNHQISQQTQLRGLEREANTLAGQSQPPPPPPPKWPGMISSEQLSLELHQVEREIGKRTRELSMENQCSLDMKSKLNTSKQAENGQPEPQNKVPAEDLTLTFSSDVPNGSALTQENISLLSNKTSSLNLSEDPEGGGDNNDSQRSGVTPSSAP

SEQ ID NO: 74634 - protein, 1133 aa, Homo sapiens; identical to SEQ ID NO: 74632
  Payload ID: 14748
  Gene Symbol: RC3H1
  Gene Name: ring finger and CCCH-type domains 1
  Uniprot ID: Q5TC82
  ENSP ID: ENSP00000356669

SEQ ID NO: 74635 - protein, 506 aa, Homo sapiens
  Payload ID: 14749
  Gene Symbol: RC3H2
  Gene Name: ring finger and CCCH-type domains 2
  ENSP ID: ENSP00000335150
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKCNPRGLYLHCCLLSSVASLGTVHNELYKQQHCDREKISVCAVKRAETCFSSQFFSPLEVPREED

SEQ ID NO: 74636 - protein, 1191 aa, Homo sapiens
  Payload ID: 14749
  Gene Symbol: RC3H2
  Gene Name: ring finger and CCCH-type domains 2
  Uniprot ID: Q9HBD1
  ENSP ID: ENSP00000349783
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGEDHVILEEQKTILPVTSCFSQPLPVSISNASCLPITTSVSAGNLILKTHVMSEDKNDFLKPVANGKMVNS

SEQ ID NO: 74637 - protein, 1191 aa, Homo sapiens; identical to SEQ ID NO: 74636
  Payload ID: 14749
  Gene Symbol: RC3H2
  Gene Name: ring finger and CCCH-type domains 2
  Uniprot ID: Q9HBD1
  ENSP ID: ENSP00000362774

SEQ ID NO: 74638 - protein, 111 aa, Homo sapiens
  Payload ID: 14749
  Gene Symbol: RC3H2
  Gene Name: ring finger and CCCH-type domains 2
  ENSP ID: ENSP00000381663
LMDLDSGDVKRRVHLFETQRRTKEEDPIIPFSDGPIISKWGAISRSSRTGYHTTDPVQATASQGSATKPISVSGGVHMATRPHHQHTMLKGTDSLLLIYLVIESIPVLGTF

SEQ ID NO: 74639 - protein, 188 aa, Homo sapiens
  Payload ID: 14749
  Gene Symbol: RC3H2
  Gene Name: ring finger and CCCH-type domains 2
  ENSP ID: ENSP00000398081
  MOD_RES (1)..(1): Any amino acid
XYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGRSKKQFCR

SEQ ID NO: 74640 - protein, 1064 aa, Homo sapiens
  Payload ID: 14749
  Gene Symbol: RC3H2
  Gene Name: ring finger and CCCH-type domains 2
  Uniprot ID: Q9HBD1
  ENSP ID: ENSP00000411767
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGEVKKLNLSASCLMYLFSAAASWLYHY

SEQ ID NO: 74641 - protein, 218 aa, Homo sapiens
  Payload ID: 14749
  Gene Symbol: RC3H2
  Gene Name: ring finger and CCCH-type domains 2
  Uniprot ID: Q9HBD1
  ENSP ID: ENSP00000474148
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPGKIGYYLTFFISYWGLRMPISGAR

SEQ ID NO: 74642 - protein, 478 aa, Homo sapiens
  Payload ID: 14749
  Gene Symbol: RC3H2
  Gene Name: ring finger and CCCH-type domains 2
  Uniprot ID: Q9HBD1
  ENSP ID: ENSP00000474709
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATEVLKQQGKLFQVQTEFQMQKTVFPS

SEQ ID NO: 74643 - protein, 261 aa, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENSP ID: ENSP00000321239
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 74644 - protein, 221 aa, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENSP ID: ENSP00000370220
MAATAREDGASGQERGQRGCEHYDRGCLLKAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 74645 - protein, 252 aa, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENSP ID: ENSP00000421084
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRGYRCPLCMHSALDMTRYWRQLDDEVAQTPMPSEYQNMTVDILCNDCNGRSTVQFHILGMKCKICESYNTAQAGGRRISLDQQ

SEQ ID NO: 74646 - protein, 107 aa, Homo sapiens
  Payload ID: 14750
  Gene Symbol: RCHY1
  Gene Name: ring finger and CHY zinc finger domain containing 1, E3 ubiquitin protein ligase
  ENSP ID: ENSP00000421958
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGI

SEQ ID NO: 74647 - protein, 239 aa, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENSP ID: ENSP00000423976
MAPAVKSEAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 74648 - protein, 212 aa, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENSP ID: ENSP00000424472
MAATAREDGASGQERGQRGCEHYDRGCLLKAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRGYRCPLCMHSALDMTRYWRQLDDEVAQTPMPSEYQNMTVDILCNDCNGRSTVQFHILGMKCKICESYNTAQAGGRRISLDQQ

SEQ ID NO: 74649 - protein, 188 aa, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENSP ID: ENSP00000424631
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEYDQVLETAG

SEQ ID NO: 74650 - protein, 111 aa, Homo sapiens
  Payload ID: 14750
  Gene Symbol: RCHY1
  Gene Name: ring finger and CHY zinc finger domain containing 1, E3 ubiquitin protein ligase
  ENSP ID: ENSP00000427205
SGQERGQRGCEHYDRGCLLKVTPSMDSSLTSFRQAPCCDKLYTCRLCHDNNEDHQLDRFKVKEVQCINCEKIQHAQQTCEECSTLFGEYYCDICHLFDKDKKQYHCENCGI

SEQ ID NO: 74651 - protein, 363 aa, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENSP ID: ENSP00000326170
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQANGHVSQDQEEPVYLESVARVPAEDETQSIDSEDSFVPGRRASLSDLTDLEDIEGLTVRQLKEILARNFVNYKGCCEKWELMERVTRLYKDQKGLQHLVSGAEDQNGGAVPSGLEENLCKICMDSPIDCVLLECGHMVTCTKCGKRMNECPICRQYVIRAVHVFRS

SEQ ID NO: 74652 - protein, 363 aa, Homo sapiens; identical to SEQ ID NO: 74651
  Payload ID: 14751
  Gene Symbol: RFFL
  Gene Name: ring finger and FYVE-like domain containing E3 ubiquitin protein ligase
  Uniprot ID: Q8WZ73
  ENSP ID: ENSP00000378096

SEQ ID NO: 74653 - protein, 363 aa, Homo sapiens; identical to SEQ ID NO: 74651
  Payload ID: 14751
  Gene Symbol: RFFL
  Gene Name: ring finger and FYVE-like domain containing E3 ubiquitin protein ligase
  Uniprot ID: Q8WZ73
  ENSP ID: ENSP00000389832

SEQ ID NO: 74654 - protein, 152 aa, Homo sapiens
  Payload ID: 14751
  Gene Symbol: RFFL
  Gene Name: ring finger and FYVE-like domain containing E3 ubiquitin protein ligase
  ENSP ID: ENSP00000395090
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLS

SEQ ID NO: 74655 - protein, 355 aa, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENSP ID: ENSP00000408513
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQANGHVSQDQEEPVYLESVARVPAEDETQSIDSEDSFVPGRRASLSDLTDLEDIEGLTVRQLKEILARNFVNYKGCCEKWELMERVTRLYKDQKGLQHLGGAVPSGLEENLCKICMDSPIDCVLLECGHMVTCTKCGKRMNECPICRQYVIRAVHVFRS

SEQ ID NO: 74656 - protein, 363 aa, Homo sapiens; identical to SEQ ID NO: 74651
  Payload ID: 14751
  Gene Symbol: RFFL
  Gene Name: ring finger and FYVE-like domain containing E3 ubiquitin protein ligase
  Uniprot ID: Q8WZ73
  ENSP ID: ENSP00000412322

SEQ ID NO: 74657 - protein, 127 aa, Homo sapiens
  Payload ID: 14751
  Gene Symbol: RFFL
  Gene Name: ring finger and FYVE-like domain containing E3 ubiquitin protein ligase
  ENSP ID: ENSP00000462499
MWATCCNWFCLDGQPEEVPPPQGARMQAYSNPGYSSFPSPTGLEPSCKSCGAHFANTARKANGHVSQDQEEPVYLESVARVPAEDETQSIDSEDSFVPGRRASLSDLTDLEDIEGLTVRQLKEILAR

SEQ ID NO: 74658 - protein, 141 aa, Homo sapiens
  Payload ID: 14751
  Gene Symbol: RFFL
  Gene Name: ring finger and FYVE-like domain containing E3 ubiquitin protein ligase
  ENSP ID: ENSP00000462656
  MOD_RES (1)..(1): Any amino acid
XTSVPPAQVQENQQSIDSEDSFVPGRRASLSDLTDLEDIEGLTVRQLKEILARNFVNYKGCCEKWELMERVTRLYKDQKGLQHLVSGAEDQNGGAVPSGLEENLCKICMDSPIDCVLLECGHMVTCTKCGKRMNECPICRQ

SEQ ID NO: 74659 - protein, 327 aa, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENSP ID: ENSP00000463035
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQSIDSEDSFVPGRRASLSDLTDLEDIEGLTVRQLKEILARNFVNYKGCCEKWELMERVTRLYKDQKGLQHLGGAVPSGLEENLCKICMDSPIDCVLLECGHMVTCTKCGKRMNECPICRQYVIRAVHVFRS

SEQ ID NO: 74660 - protein, 60 aa, Homo sapiens
  Payload ID: 14751
  Gene Symbol: RFFL
  Gene Name: ring finger and FYVE-like domain containing E3 ubiquitin protein ligase
  ENSP ID: ENSP00000464000
MWATCCNWFCLDGQPEEVPPPQGARMQAYSNPGYSSFPSPTGLEPSCKSCGAHFANTARK

SEQ ID NO: 74661 - protein, 576 aa, Homo sapiens
  Payload ID: 14752
  Gene Symbol: RSPRY1
  Gene Name: ring finger and SPRY domain containing 1
  Uniprot ID: Q96DX4
  ENSP ID: ENSP00000377942
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLIRVIPLEDPLGPAVITLLLDECPLPTKDALQKLTEILNLNGEVACQDSSHPAKHRNTSAVLGCLAEKLAGPASIGLLSPGILEYLLQCLKLQSHPTVMLFALIALEKFAQTSENKLTISESSISDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWATRDSKFLNHEGYGIGDDEYSCAYDGCRQLIWYNARSKPHIHPCWKEGDTVGFLLDLNEKQMIFFLNGNQLPPEKQVFSSTVSGFFAAASFMSYQQCEFNFGAKPFKYPPSMKFSTFNDYAFLTAEEKIILPRHRRLALLKQVSIRENCCSLCCDEVADTQLKPCGHSDLCMDCALQLETCPLCRKEIVSRIRQISHIS

SEQ ID NO: 74662 - protein, 576 aa, Homo sapiens; identical to SEQ ID NO: 74661
  Payload ID: 14752
  Gene Symbol: RSPRY1
  Gene Name: ring finger and SPRY domain containing 1
  Uniprot ID: Q96DX4
  ENSP ID: ENSP00000443176

SEQ ID NO: 74663 - protein, 172 aa, Homo sapiens
  Payload ID: 14752
  Gene Symbol: RSPRY1
  Gene Name: ring finger and SPRY domain containing 1
  ENSP ID: ENSP00000455367
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDKRKLQNEDAYIGPCFHKSSTGIVVSLPGISLSDQEPPYSMITLHEMAETDEGWLDV

SEQ ID NO: 74664 - protein, 45 aa, Homo sapiens
  Payload ID: 14752
  Gene Symbol: RSPRY1
  Gene Name: ring finger and SPRY domain containing 1
  ENSP ID: ENSP00000455768
MITLHEMAETDEGWLDVVQSLIRVIPLEDPLGPAVITLLLDECPL

SEQ ID NO: 74665 - protein, 121 aa, Homo sapiens
  Payload ID: 14752
  Gene Symbol: RSPRY1
  Gene Name: ring finger and SPRY domain containing 1
  ENSP ID: ENSP00000455891
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEP

SEQ ID NO: 74666 - protein, 146 aa, Homo sapiens
  Payload ID: 14752
  Gene Symbol: RSPRY1
  Gene Name: ring finger and SPRY domain containing 1
  ENSP ID: ENSP00000456646
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLI

SEQ ID NO: 74667 - protein, 146 aa, Homo sapiens; identical to SEQ ID NO: 74666
  Payload ID: 14752
  Gene Symbol: RSPRY1
  Gene Name: ring finger and SPRY domain containing 1
  ENSP ID: ENSP00000457705

SEQ ID NO: 74668 - protein, 707 aa, Homo sapiens
  Payload ID: 14753
  Gene Symbol: RFWD2
  Gene Name: ring finger and WD repeat domain 2, E3 ubiquitin protein ligase
  Uniprot ID: Q8NHY2
  ENSP ID: ENSP00000310943
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSNGHRWQIFQDWLGTDQDNLDLANVNLMLELLVQKKKQLEAESHAAQLQILMEFLKVARRNKREEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 74669 - protein, 566 aa, Homo sapiens
  Payload ID: 14753
  Gene Symbol: RFWD2
  Gene Name: ring finger and WD repeat domain 2, E3 ubiquitin protein ligase
  ENSP ID: ENSP00000356638
AYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 74670 - protein, 113 aa, Homo sapiens
  Payload ID: 14753
  Gene Symbol: RFWD2
  Gene Name: ring finger and WD repeat domain 2, E3 ubiquitin protein ligase
  ENSP ID: ENSP00000356639
  MOD_RES (1)..(1): Any amino acid
XAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLGITCSPTTDSYGIPQGCKKK

SEQ ID NO: 74671 - protein, 731 aa, Homo sapiens
  Payload ID: 14753
  Gene Symbol: RFWD2
  Gene Name: ring finger and WD repeat domain 2, E3 ubiquitin protein ligase
  Uniprot ID: Q8NHY2
  ENSP ID: ENSP00000356641
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 74672 - protein, 157 aa, Homo sapiens
  Payload ID: 14753
  Gene Symbol: RFWD2
  Gene Name: ring finger and WD repeat domain 2, E3 ubiquitin protein ligase
  Uniprot ID: Q8NHY2
  ENSP ID: ENSP00000433517
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCE

SEQ ID NO: 74673 - protein, 189 aa, Homo sapiens
  Payload ID: 14753
  Gene Symbol: RFWD2
  Gene Name: ring finger and WD repeat domain 2, E3 ubiquitin protein ligase
  ENSP ID: ENSP00000433810
MIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREEMSGLYSPVSEDSTVPQFEAPSPSHSSIIDSTEYSQPPGFSGSSQTKKQPWYN

SEQ ID NO: 74674 - protein, 247 aa, Homo sapiens
  Payload ID: 14753
  Gene Symbol: RFWD2
  Gene Name: ring finger and WD repeat domain 2, E3 ubiquitin protein ligase
  ENSP ID: ENSP00000437212
  MOD_RES (1)..(1): Any amino acid
XSGLYSPVSEDSTVPQFEAPSPSHSLEFSSDMHRIFVNGILIISIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPK

SEQ ID NO: 74675 - protein, 68 aa, Homo sapiens
  Payload ID: 14753
  Gene Symbol: RFWD2
  Gene Name: ring finger and WD repeat domain 2, E3 ubiquitin protein ligase
  ENSP ID: ENSP00000437275
MIEEAYMTKCGHSFCYKCIHQSLEDNNRCPKCNYVVDNIDHLYPNFLVCILCLLLSASLGFECSLSLS

SEQ ID NO: 74676 - protein, 774 aa, Homo sapiens
  Payload ID: 14754
  Gene Symbol: RFWD3
  Gene Name: ring finger and WD repeat domain 3
  Uniprot ID: Q6PCD5
  ENSP ID: ENSP00000354361
MAHEAMEYDVQVQLNHAEQQPAPAGMASSQGGPALLQPVPADVVSSQGVPSILQPAPAEVISSQATPPLLQPAPQLSVDLTEVEVLGEDTVENINPRTSEQHRQGSDGNHTIPASSLHSMTNFISGLQRLHGMLEFLRPSSSNHSVGPMRTRRRVSASRRARAGGSQRTDSARLRAPLDAYFQVSRTQPDLPATTYDSETRNPVSEELQVSSSSDSDSDSSAEYGGVVDQAEESGAVILEEQLAGVSAEQEVTCIDGGKTLPKQPSPQKSEPLLPSASMDEEEGDTCTICLEQWTNAGDHRLSALRCGHLFGYRCISTWLKGQVRKCPQCNKKARHSDIVVLYARTLRALDTSEQERMKSSLLKEQMLRKQAELESAQCRLQLQVLTDKCTRLQRRVQDLQKLTSHQSQNLQQPRGSQAWVLSCSPSSQGQHKHKYHFQKTFTVSQAGNCRIMAYCDALSCLVISQPSPQASFLPGFGVKMLSTANMKSSQYIPMHGKQIRGLAFSSYLRGLLLSASLDNTIKLTSLETNTVVQTYNAGRPVWSCCWCLDEANYIYAGLANGSILVYDVRNTSSHVQELVAQKARCPLVSLSYMPRAASAAFPYGGVLAGTLEDASFWEQKMDFSHWPHVLPLEPGGCIDFQTENSSRHCLVTYRPDKNHTTIRSVLMEMSYRLDDTGNPICSCQPVHTFFGGPTCKLLTKNAIFQSPENDGNILVCTGDEAANSALLWDAASGSLLQDLQTDQPVLDICPFEVNRNSYLATLTEKMVHIYKWE

SEQ ID NO: 74677 - protein, 24 aa, Homo sapiens
  Payload ID: 14754
  Gene Symbol: RFWD3
  Gene Name: ring finger and WD repeat domain 3
  ENSP ID: ENSP00000459465
MDEEEGDTCTICLEQWTNAGDHRL

SEQ ID NO: 74678 - protein, 122 aa, Homo sapiens
  Payload ID: 14754
  Gene Symbol: RFWD3
  Gene Name: ring finger and WD repeat domain 3
  ENSP ID: ENSP00000459515
MAHEAMEYDVQVQLNHAEQQPAPAGMASSQGGPALLQPVPADVVSSQGVPSILQPAPAEVISSQATPPLLQPAPQLSVDLTEVEVLGEDTVENINPRTSEQHRQGSDGNHTIPASSLHSMTN

SEQ ID NO: 74679 - protein, 150 aa, Homo sapiens
  Payload ID: 14754
  Gene Symbol: RFWD3
  Gene Name: ring finger and WD repeat domain 3
  ENSP ID: ENSP00000459899
MAHEAMEYDVQVQLNHAEQQPAPAGMASSQGGPALLQPVPADVVSSQGVPSILQPAPAEVISSQATPPLLQPAPQLSVDLTEVEVLGEDTVENINPRTSEQHRQGSDGNHTIPASSLHSMTNFISGLQRLHGMLEFLRPSSSNHSVGPMR

SEQ ID NO: 74680 - protein, 774 aa, Homo sapiens; identical to SEQ ID NO: 74676
  Payload ID: 14754
  Gene Symbol: RFWD3
  Gene Name: ring finger and WD repeat domain 3
  Uniprot ID: Q6PCD5
  ENSP ID: ENSP00000460049

SEQ ID NO: 74681 - protein, 116 aa, Homo sapiens
  Payload ID: 14754
  Gene Symbol: RFWD3
  Gene Name: ring finger and WD repeat domain 3
  ENSP ID: ENSP00000461285
MAHEAMEYDVQVQLNHAEQQPAPAGMASSQGGPALLQPVPADVVSSQGVPSILQPAPAEVISSQATPPLLQPAPQLSVDLTEVEVLGEDTVENINPRTSEQHRQGSDGNHTIPASS

SEQ ID NO: 74682 - protein, 685 aa, Homo sapiens [sequence omitted]

SEQ ID NO: 74683 - protein, 685 aa, Homo sapiens [sequence omitted]

SEQ ID NO: 74684 - protein, 685 aa, Homo sapiens [sequence omitted]

SEQ ID NO: 74685 - protein, 406 aa, Homo sapiens
  Payload ID: 14756
  Gene Symbol: RING1
  Gene Name: ring finger protein 1
  Uniprot ID: Q06587
  ENSP ID: ENSP00000363787
MTTPANAQNASKTWELSLYELHRTPQEAIMDGTEIAVSPRSLHSELMCPICLDMLKNTMTTKECLHRFCSDCIVTALRSGNKECPTCRKKLVSKRSLRPDPNFDALISKIYPSREEYEAHQDRVLIRLSRLHNQQALSSSIEEGLRMQAMHRAQRVRRPIPGSDQTTTMSGGEGEPGEGEGDGEDVSSDSAPDSAPGPAPKRPRGGGAGGSSVGTGGGGTGGVGGGAGSEDSGDRGGTLGGGTLGPPSPPGAPSPPEPGGEIELVFRPHPLLVEKGEYCQTRYVKTTGNATVDHLSKYLALRIALERRQQQEAGEPGGPGGGASDTGGPDGCGGEGGGAGGGDGPEEPALPSLEGVSEKQYTIYIAPGGGAFTTLNGSLTLELVNEKFWKVSRPLELCYAPTKDPK

SEQ ID NO: 74686 - protein, 406 aa, Homo sapiens; identical to SEQ ID NO: 74685
  Payload ID: 14756
  Gene Symbol: RING1
  Gene Name: ring finger protein 1
  Uniprot ID: Q06587
  ENSP ID: ENSP00000372699

SEQ ID NO: 74687 - protein, 406 aa, Homo sapiens; identical to SEQ ID NO: 74685
  Payload ID: 14756
  Gene Symbol: RING1
  Gene Name: ring finger protein 1
  Uniprot ID: Q06587
  ENSP ID: ENSP00000396271

SEQ ID NO: 74688 - protein, 406 aa, Homo sapiens; identical to SEQ ID NO: 74685
  Payload ID: 14756
  Gene Symbol: RING1
  Gene Name: ring finger protein 1
  Uniprot ID: Q06587
  ENSP ID: ENSP00000396439

SEQ ID NO: 74689 - protein, 406 aa, Homo sapiens; identical to SEQ ID NO: 74685
  Payload ID: 14756
  Gene Symbol: RING1
  Gene Name: ring finger protein 1
  Uniprot ID: Q06587
  ENSP ID: ENSP00000400572

SEQ ID NO: 74690 - protein, 406 aa, Homo sapiens; identical to SEQ ID NO: 74685
  Payload ID: 14756
  Gene Symbol: RING1
  Gene Name: ring finger protein 1
  Uniprot ID: Q06587
  ENSP ID: ENSP00000412190

SEQ ID NO: 74691 - protein, 811 aa, Homo sapiens
  Payload ID: 14757
  Gene Symbol: RNF10
  Gene Name: ring finger protein 10
  Uniprot ID: Q8N5U6
  ENSP ID: ENSP00000322242
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 74692 - protein, 816 aa, Homo sapiens
  Payload ID: 14757
  Gene Symbol: RNF10
  Gene Name: ring finger protein 10
  Uniprot ID: Q8N5U6
  ENSP ID: ENSP00000415682
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKSLLQQGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 74693 - protein, 137 aa, Homo sapiens
  Payload ID: 14757
  Gene Symbol: RNF10
  Gene Name: ring finger protein 10
  ENSP ID: ENSP00000437392
  MOD_RES (1)..(1): Any amino acid
XEQHSQYSKLLLASKEQVLHRVVLEEKVALEQQLAEEKHTPESCFIEAAIQELKTREEALSGLAGSRREVTGVVAALEQLVLMAPLAKESVFQPRKSLLQQGVLEYLSAFDEETTEVCSLDTPSRPLALPLVEEEEA

SEQ ID NO: 74694 - protein, 8 aa, Homo sapiens
  Payload ID: 14757
  Gene Symbol: RNF10
  Gene Name: ring finger protein 10
  ENSP ID: ENSP00000438638
MPLSSPNA

SEQ ID NO: 74695 - protein, 99 aa, Homo sapiens
  Payload ID: 14757
  Gene Symbol: RNF10
  Gene Name: ring finger protein 10
  ENSP ID: ENSP00000439221
MSEDVRQRHRYLSHLPLTCEFSICELALQPPVVSKETLEMFSDDIEKRKRQRQKKAREERRRERRIEIEENKKQGKYPEVHIPLENLQQFPAFNSYTCS

SEQ ID NO: 74696 - protein, 183 aa, Homo sapiens
  Payload ID: 14757
  Gene Symbol: RNF10
  Gene Name: ring finger protein 10
  ENSP ID: ENSP00000439510
  MOD_RES (1)..(1): Any amino acid
XDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKGVLEYLSAF

SEQ ID NO: 74697 - protein, 211 aa, Homo sapiens
  Payload ID: 14757
  Gene Symbol: RNF10
  Gene Name: ring finger protein 10
  ENSP ID: ENSP00000439859
VSEPEPEGLPEACDDLELADDNLKEGTICTESSQQEPITKSGFTRLSSSPCYYFYQDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGAL

SEQ ID NO: 74698 - protein, 146 aa, Homo sapiens
  Payload ID: 14757
  Gene Symbol: RNF10
  Gene Name: ring finger protein 10
  ENSP ID: ENSP00000441487
RERRIEIEENKKQGKYFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 74699 - protein, 84 aa, Homo sapiens
  Payload ID: 14757
  Gene Symbol: RNF10
  Gene Name: ring finger protein 10
  ENSP ID: ENSP00000443000
MPLSSPNAAATASDMDKNSGSNSSSASSGSSKGQQPPRSASAGPAGESKPKSELLISAGFNLLSVDSVVRPYVAPLEVLVNYSG

SEQ ID NO: 74700 - protein, 124 aa, Homo sapiens
  Payload ID: 14757
  Gene Symbol: RNF10
  Gene Name: ring finger protein 10
  ENSP ID: ENSP00000443235
MMDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHK

SEQ ID NO: 74701 - protein, 104 aa, Homo sapiens
  Payload ID: 14757
  Gene Symbol: RNF10
  Gene Name: ring finger protein 10
  ENSP ID: ENSP00000443790
SNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDELPICGV

SEQ ID NO: 74702 - protein, 118 aa, Homo sapiens
  Payload ID: 14757
  Gene Symbol: RNF10
  Gene Name: ring finger protein 10
  ENSP ID: ENSP00000444770
MPLSSPNAAATASDMDKNSGSNSSSASSGSSKGQQPPRSASAGPAGESKPKSELLISAGFNLLSVDSVVRPYVAPLEEKVALEQQLAEEKHTPESCFIEAAIQELKTREEALSGLAGS

SEQ ID NO: 74703 - protein, 261 aa, Homo sapiens
  Payload ID: 14757
  Gene Symbol: RNF10
  Gene Name: ring finger protein 10
  ENSP ID: ENSP00000445160
EACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQEFYWPVVGSES

SEQ ID NO: 74704 - protein, 685 aa, Homo sapiens
  Payload ID: 14758
  Gene Symbol: RNF103
  Gene Name: ring finger protein 103
  Uniprot ID: O00237
  ENSP ID: ENSP00000237455
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 74705 - protein, 154 aa, Homo sapiens
  Payload ID: 14759
  Gene Symbol: RNF11
  Gene Name: ring finger protein 11
  Uniprot ID: Q9Y3C5
  ENSP ID: ENSP00000242719
MGNCLKSPTSDDISLLHESQSDRASFGEGTEPDQEPPPPYQEQVPVPVYHPTPSQTRLATQLTEEEQIRIAQRIGLIQHLPKGVYDPGRDGSEKKIRECVICMMDFVYGDPIRFLPCMHIYHLDCIDDWLMRSFTCPSCMEPVDAALLSSYETN

SEQ ID NO: 74706 - protein, 986 aa, Homo sapiens
  Payload ID: 14760
  Gene Symbol: RNF111
  Gene Name: ring finger protein 111
  Uniprot ID: Q6ZNA4
  ENSP ID: ENSP00000288199
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKRKLHCKQDGEEGTEEDTEEKCTICLSILEEGEDVRRLPCMHLFHQVCVDQWLITNKKCPICRVDIEAQLPSES

SEQ ID NO: 74707 - protein, 994 aa, Homo sapiens
  Payload ID: 14760
  Gene Symbol: RNF111
  Gene Name: ring finger protein 111
  Uniprot ID: Q6ZNA4
  ENSP ID: ENSP00000452732
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKVTTDWFSQRKLHCKQDGEEGTEEDTEEKCTICLSILEEGEDVRRLPCMHLFHQVCVDQWLITNKKCPICRVDIEAQLPSES

SEQ ID NO: 74708 - protein, 128 aa, Homo sapiens
  Payload ID: 14760
  Gene Symbol: RNF111
  Gene Name: ring finger protein 111
  ENSP ID: ENSP00000452842
MHVFSLIDGSSGLAVLRLSLKFPMSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYV

SEQ ID NO: 74709 - protein, 131 aa, Homo sapiens
  Payload ID: 14760
  Gene Symbol: RNF111
  Gene Name: ring finger protein 111
  ENSP ID: ENSP00000452919
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDND

SEQ ID NO: 74710 - protein, 1003 aa, Homo sapiens
  Payload ID: 14760
  Gene Symbol: RNF111
  Gene Name: ring finger protein 111
  Uniprot ID: Q6ZNA4
  ENSP ID: ENSP00000453015
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTGLFVFCVSRRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKVTTDWFSQRKLHCKQDGEEGTEEDTEEKCTICLSILEEGEDVRRLPCMHLFHQVCVDQWLITNKKCPICRVDIEAQLPSES

SEQ ID NO: 74711 - protein, 190 aa, Homo sapiens
  Payload ID: 14760
  Gene Symbol: RNF111
  Gene Name: ring finger protein 111
  ENSP ID: ENSP00000453248
SSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGGM

SEQ ID NO: 74712 - protein, 995 aa, Homo sapiens
  Payload ID: 14760
  Gene Symbol: RNF111
  Gene Name: ring finger protein 111
  Uniprot ID: Q6ZNA4
  ENSP ID: ENSP00000453872
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTGLFVFCVSRRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKRKLHCKQDGEEGTEEDTEEKCTICLSILEEGEDVRRLPCMHLFHQVCVDQWLITNKKCPICRVDIEAQLPSES

SEQ ID NO: 74713 - protein, 631 aa, Homo sapiens
  Payload ID: 14761
  Gene Symbol: RNF112
  Gene Name: ring finger protein 112
  Uniprot ID: Q9ULX5
  ENSP ID: ENSP00000454919
MPRPALSVTSFCHRLGKRERKQSFMGNSGNSWSHTPFPKLELGLGPQPMAPRELPTCSICLERLRDPISLDCGHDFCIRCFSTHRLPGCEPPCCPECRKICKQKRGLRSLGEKMKLLPQRPLPPALQETCPVRAEPLLLVRINASGGLILRMGAINRCLKHPLARDTPVCLLAVLGEQHSGKSFLLNHLLQGLPGLESGEGGRPRGGEASLQGCRWGANGLARGIWMWSHPFLLGKEGKKVAVFLVDTGDAMSPELSRETRIKLCALTTMLSSYQILSTSQELKDTDLDYLEMFVHVAEVMGKHYGMVPIQHLDLLVRDSSHPNKAGQGHVGNIFQRLSGRYPKVQELLQGKRARCCLLPAPGRRRMNQGHASPGDTDDDFRHLLGAYVSDVLSAAPQHAKSRCQGYWNEGRAVARGDRRLLTGQQLAQEIKNLSGWMGRTGPGFTSPDEMAAQLHDLRKVEAAKREFEEYVRQQDVATKRIFSALRVLPDTMRNLLSTQKDAILARHGVALLCKGRDQTLEALEAELQATAKAFMDSYTMRFCGHLAAVGGAVGAGLMGLAGGVVGAGMAAAALAAEAGMVAAGAAVGATGAAVVGGGVGAGLAATVGCMEKEEDERLLEGDREPLLQEE

SEQ ID NO: 74714 - protein, 123 aa, Homo sapiens
  Payload ID: 14761
  Gene Symbol: RNF112
  Gene Name: ring finger protein 112
  ENSP ID: ENSP00000464134
MPRPALSVTSFCHRLGKRERKQSFMGNSGNSWSHTPFPKLELGLGPQPMAPRELPTCSICLERLRDPISLDCGHDFCIRCFSTHRLPGCEPPCCPECRKICKQKRGLRSLGEKMKLLPQRPLP

SEQ ID NO: 74715 - protein, 343 aa, Homo sapiens
  Payload ID: 14762
  Gene Symbol: RNF113A
  Gene Name: ring finger protein 113A
  Uniprot ID: O15541
  ENSP ID: ENSP00000360497
MAEQLSPGKAVDQVCTFLFKKPGRKGAAGRRKRPACDPEPGESGSSSDEGCTVVRPEKKRVTHNPMIQKTRDSGKQKAAYGDLSSEEEEENEPESLGVVYKSTRSAKPVGPEDMGATAVYELDTEKERDAQAIFERSQKIQEELRGKEDDKIYRGINNYQKYMKPKDTSMGNASSGMVRKGPIRAPEHLRATVRWDYQPDICKDYKETGFCGFGDSCKFLHDRSDYKHGWQIERELDEGRYGVYEDENYEVGSDDEEIPFKCFICRQSFQNPVVTKCRHYFCESCALQHFRTTPRCYVCDQQTNGVFNPAKELIAKLEKHRATGEGGASDLPEDPDEDAIPIT

SEQ ID NO: 74716 - protein, 322 aa, Homo sapiens
  Payload ID: 14763
  Gene Symbol: RNF113B
  Gene Name: ring finger protein 113B
  Uniprot ID: Q8IZP6
  ENSP ID: ENSP00000267291
MAAPPSPGRTADQADQVCTFLFKKPGRKGAAGLRKRPACDPEHGESSSSGDEGDTVAQPPRVAPRPRGLHSWQKAAHGDRRGEEAAPESLDVVYRSTRSAKPVGPEDMGATADFEQDTEKEHHTPTILKCSQRVQEALRGREHDHIYRGIHSYLRYLKPKDTSMGNSSSGMARKGPIRAPGHLRATVRWDYQPDICKDYKETGFCGFGDSCKFLHDRSDYKLGWEIERELEEGRYCICEDENHEVGSEEEEIPFRCFICRQAFQNPVVTKCRHYFCESCALEHFRATPRCYICDQPTGGIFNPAKELMAKLQKLQAAEGKKR

SEQ ID NO: 74717 - protein, 228 aa, Homo sapiens
  Payload ID: 14764
  Gene Symbol: RNF114
  Gene Name: ring finger protein 114
  Uniprot ID: Q9Y508
  ENSP ID: ENSP00000244061
MAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVVCPICASMPWGDPNYRSANFREHIQRRHRFSYDTFVDYDVDEEDMMNQVLQRSIIDQ

SEQ ID NO: 74718 - protein, 70 aa, Homo sapiens
  Payload ID: 14764
  Gene Symbol: RNF114
  Gene Name: ring finger protein 114
  ENSP ID: ENSP00000485136
MAAQQRDCGGAAQLAGPAAEADPLGRFTCPVCLEVYEKPVQVPCGHVSSCPRSGPTWLLVPNTRITSWKV

SEQ ID NO: 74719 - protein, 49 aa, Homo sapiens
  Payload ID: 14764
  Gene Symbol: RNF114
  Gene Name: ring finger protein 114
  ENSP ID: ENSP00000485203
MAAQQRDCGGAAQLAGPAAEADPLGRFTCPVCLEVYEKPVQVPCGHVNV

SEQ ID NO: 74720 - protein, 188 aa, Homo sapiens
  Payload ID: 14764
  Gene Symbol: RNF114
  Gene Name: ring finger protein 114
  ENSP ID: ENSP00000485239
MAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVDYDVDEEDMMNQVLQRS

SEQ ID NO: 74721 - protein, 206 aa, Homo sapiens
  Payload ID: 14764
  Gene Symbol: RNF114
  Gene Name: ring finger protein 114
  ENSP ID: ENSP00000485317
MAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVVMSRVRACYLSHVTELPLHIKREIYDSCTLPVQQT

SEQ ID NO: 74722 - protein, 83 aa, Homo sapiens
  Payload ID: 14764
  Gene Symbol: RNF114
  Gene Name: ring finger protein 114
  ENSP ID: ENSP00000485575
MAAQQRDCGGAAQLAGPAAEADPLGRFTCPVCLEVYEKPVQVPCGHVALPSPVMIAAPVCGAFCKGWTLCQGSAIQTVSSQQS

SEQ ID NO: 74723 - protein, 304 aa, Homo sapiens
  Payload ID: 14765
  Gene Symbol: RNF115
  Gene Name: ring finger protein 115
  Uniprot ID: Q9Y4L5
  ENSP ID: ENSP00000463650
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 74724 - protein, 327 aa, Homo sapiens
  Payload ID: 14766
  Gene Symbol: RNF121
  Gene Name: ring finger protein 121
  Uniprot ID: Q9H920
  ENSP ID: ENSP00000354571
MAAVVEVEVGGGAAGERELDEVDMSDLSPEEQWRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 74725 - protein, 113 aa, Homo sapiens
  Payload ID: 14766
  Gene Symbol: RNF121
  Gene Name: ring finger protein 121
  ENSP ID: ENSP00000377314
MAAVVEVEVGGGAAGERELDEVDMSDLSPEEQWRVEHARMHAKHRGHEAMHAEMVLILIATLVVAQLLLVQWKQRHPRSYNRWGFTVLPRLVSSSWAQAIHLPQPPNVLELQE

SEQ ID NO: 74726 - protein, 205 aa, Homo sapiens
  Payload ID: 14766
  Gene Symbol: RNF121
  Gene Name: ring finger protein 121
  ENSP ID: ENSP00000377316
MRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGRCSASTSSASVAGASWERSKRVPTAKRR

SEQ ID NO: 74727 - protein, 295 aa, Homo sapiens
  Payload ID: 14766
  Gene Symbol: RNF121
  Gene Name: ring finger protein 121
  ENSP ID: ENSP00000431286
MRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 74728 - protein, 81 aa, Homo sapiens
  Payload ID: 14766
  Gene Symbol: RNF121
  Gene Name: ring finger protein 121
  ENSP ID: ENSP00000431325
MAAVVEVEVGGGAAGERELDEVDMSDLSPEEQWRVEHARMHAKHRGHEAMHAEMVLILIATLVVAQLLLVQWKQRHPRSYN

SEQ ID NO: 74729 - protein, 52 aa, Homo sapiens
  Payload ID: 14766
  Gene Symbol: RNF121
  Gene Name: ring finger protein 121
  ENSP ID: ENSP00000432898
MRVEHARMHAKHRGHEAMHAEMVLILIATLVVAQLLLVQWKQRHPRSYNVGL

SEQ ID NO: 74730 - protein, 167 aa, Homo sapiens
  Payload ID: 14766
  Gene Symbol: RNF121
  Gene Name: ring finger protein 121
  ENSP ID: ENSP00000433574
MRVEHARMHAKHRGHEAMHAEMVLILIATLVVAQLLLVQWKQRHPRSYNFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 74731 - protein, 49 aa, Homo sapiens
  Payload ID: 14766
  Gene Symbol: RNF121
  Gene Name: ring finger protein 121
  ENSP ID: ENSP00000434127
MRVEHARMHAKHRGHEAMHAEMVLILIATLVVAQLLLVQWKQRHPRSYN

SEQ ID NO: 74732 - protein, 146 aa, Homo sapiens
  Payload ID: 14766
  Gene Symbol: RNF121
  Gene Name: ring finger protein 121
  ENSP ID: ENSP00000435859
  MOD_RES (1)..(1): Any amino acid
XEVEVGGGAAGERELDEVDMSDLSPEEQWRVEHARMHAKHRGHEAMHAEMVLILIATLVVAQLLLVQWKQRHPRSYNDQTRRCHGLWHLPSLLWPLLWSSGTGLCRNVCRLHGIYHRVLQRVGHAYQTSFRQCVCCVWAADLCGRQ

SEQ ID NO: 74733 - protein, 155 aa, Homo sapiens
  Payload ID: 14767
  Gene Symbol: RNF122
  Gene Name: ring finger protein 122
  Uniprot ID: Q9H9V4
  ENSP ID: ENSP00000256257
MHPFQWCNGCFCGLGLVSTNKSCSMPPISFQDLPLNIYMVIFGTGIFVFMLSLIFCCYFISKLRNQAQSERYGYKEVVLKGDAKKLQLYGQTCAVCLEDFKGKDELGVLPCQHAFHRKCLVKWLEVRCVCPMCNKPIASPSEATQNIGILLDELV

SEQ ID NO: 74734 - protein, 1314 aa, Homo sapiens
  Payload ID: 14768
  Gene Symbol: RNF123
  Gene Name: ring finger protein 123
  Uniprot ID: Q5XPI4
  ENSP ID: ENSP00000328287
MASKGAGMSFSRKSYRLTSDAEKSRVTGIVQEKLLNDYLNRIFSSSEHAPPAATSRKPLNFQNLPEHLDQLLQVDNEEEESQGQVEGRLGPSTVVLDHTGGFEGLLLVDDDLLGVIGHSNFGTIRSTTCVYKGKWLYEVLISSQGLMQIGWCTISCRFNQEEGVGDTHNSYAYDGNRVRKWNVTTTNYGKAWAAGDIVSCLIDLDDGTLSFCLNGVSLGTAFENLSRGLGMAYFPAISLSFKESVAFNFGSRPLRYPVAGYRPLQDPPSADLVRAQRLLGCFRAVLSVELDPVEGRLLDKESSKWRLRGQPTVLLTLAHIFHHFAPLLRKVYLVEAVLMSFLLGIVEKGTPTQAQSVVHQVLDLLWLFMEDYEVQDCLKQLMMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEVVEELQVQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 74735 - protein, 68 aa, Homo sapiens
  Payload ID: 14768
  Gene Symbol: RNF123
  Gene Name: ring finger protein 123
  ENSP ID: ENSP00000390856
MASKGAGMSFSRKSYRLTSDAEKSRVTGIVQEKLLNDYLNRIFSSSEHAPPAATSRQPPCELRGKDGI

SEQ ID NO: 74736 - protein, 762 aa, Homo sapiens
  Payload ID: 14768
  Gene Symbol: RNF123
  Gene Name: ring finger protein 123
  ENSP ID: ENSP00000392443
MQIGWCTISCRFNQEEGVGDTHNSYAYDGNRVRKWNVTTTNYGKAWAAGDIVSCLIDLDDGTLSFCLNGVSLGTAFENLSRGLGMAYFPAISLSFKESVAFNFGSRPLRYPVAGYRPLQDPPSADLVRAQRLLGCFRAVLSVELDPVEGRLLDKESSKWRLRGQPTVLLTLAHIFHHFAPLLRKVYLVEAVLMSFLLGIVEKGTPTQAQSVVHQVLDLLWLFMEDYEVQDCLKQLMMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEVVEELQVQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGDGTIQAEAEAEKGSLV

SEQ ID NO: 74737 - protein, 721 aa, Homo sapiens
  Payload ID: 14768
  Gene Symbol: RNF123
  Gene Name: ring finger protein 123
  ENSP ID: ENSP00000394369
MASKGAGMSFSRKSYRLTSDAEKSRVTGIVQEKLLNDYLNRIFSSSEHAPPAATSRKPLNFQNLPEHLDQLLQVDNEEEESQGQVEGRLGPSTVVLDHTGGFEGLLLVDDDLLGVIGHSNFGTIRSTTCVYKGKWLYEVLISSQGLMQIGWCTISCRFNQEEGVGDTHNSYAYDGNRVRKWNVTTTNYGKAWAAGDIVSCLIDLDDGTLSFCLNGVSLGTAFENLSRGLGMAYFPAISLSFKESVAFNFGSRPLRYPVAGYRPLQDPPSADLVRAQRLLGCFRAVLSVELDPVEGRLLDKESSKWRLRGQPTVLLTLAHIFHHFAPLLRKVYLVEAVLMSFLLGIVEKGTPTQAQSVVHQVLDLLWLFMEDYEVQDCLKQLMMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEVVEELQVQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDSS

SEQ ID NO: 74738 - protein, 76 aa, Homo sapiens
  Payload ID: 14768
  Gene Symbol: RNF123
  Gene Name: ring finger protein 123
  ENSP ID: ENSP00000408490
MASKGAGMSFSRKSYRLTSDAEKSRVTGIVQEKLLNDYLNRIFSSSEHAPPAATSRKPLNFQNLPEHLDQLLQVDN

SEQ ID NO: 74739 - protein, 25 aa, Homo sapiens
  Payload ID: 14768
  Gene Symbol: RNF123
  Gene Name: ring finger protein 123
  ENSP ID: ENSP00000413794
LTRLAAILAKHFADARIVGTGVSPW

SEQ ID NO: 74740 - protein, 426 aa, Homo sapiens
  Payload ID: 14768
  Gene Symbol: RNF123
  Gene Name: ring finger protein 123
  ENSP ID: ENSP00000416156
MEHGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 74741 - protein, 68 aa, Homo sapiens; identical to SEQ ID NO: 74735
  Payload ID: 14768
  Gene Symbol: RNF123
  Gene Name: ring finger protein 123
  ENSP ID: ENSP00000487104

SEQ ID NO: 74742 - protein, 232 aa, Homo sapiens
  Payload ID: 14769
  Gene Symbol: RNF125
  Gene Name: ring finger protein 125, E3 ubiquitin protein ligase
  Uniprot ID: Q96EQ8
  ENSP ID: ENSP00000217740
MGSVLSTDSGKSAPASATARALERRRDPELPVTSFDCAVCLEVLHQPVRTRCGHVFCRSCIATSLKNNKWTCPYCRAYLPSEGVPATDVAKRMKSEYKNCAECDTLVCLSEMRAHIRTCQKYIDKYGPLQELEETAARCVCPFCQRELYEDSLLDHCITHHRSERRPVFCPLCRLIPDENPSSFSGSLIRHLQVSHTLFYDDFIDFNIIEEALIRRVLDRSLLEYVNHSNTT

SEQ ID NO: 74743 - protein, 40 aa, Homo sapiens
  Payload ID: 14769
  Gene Symbol: RNF125
  Gene Name: ring finger protein 125, E3 ubiquitin protein ligase
  ENSP ID: ENSP00000463935
  MOD_RES (1)..(1): Any amino acid
XLPSEGVPATDVAKRMKSEYKNCAECDTLVCMSLLSEGTV

SEQ ID NO: 74744 - protein, 311 aa, Homo sapiens
  Payload ID: 14770
  Gene Symbol: RNF126
  Gene Name: ring finger protein 126
  Uniprot ID: Q9BV68
  ENSP ID: ENSP00000292363
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 74745 - protein, 283 aa, Homo sapiens
  Payload ID: 14770
  Gene Symbol: RNF126
  Gene Name: ring finger protein 126
  ENSP ID: ENSP00000464945
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSN

SEQ ID NO: 74746 - protein, 74 aa, Homo sapiens
  Payload ID: 14770
  Gene Symbol: RNF126
  Gene Name: ring finger protein 126
  ENSP ID: ENSP00000475833
MAEASPHPGRYFCHCCSVEIVPRLPDYICPRCESGFIEELPEETRSTENGSAPSTAPTDQSRPPLERPQQTARA

SEQ ID NO: 74747 - protein, 428 aa, Homo sapiens
  Payload ID: 14771
  Gene Symbol: RNF128
  Gene Name: ring finger protein 128, E3 ubiquitin protein ligase
  Uniprot ID: Q8TEB7
  ENSP ID: ENSP00000255499
MGPPPGAGVSCRGGCGFSRLLAWCFLLALSPQAPGSRGAEAVWTAYLNVSWRVPHTGVNRTVWELSEEGVYGQDSPLEPVAGVLVPPDGPGALNACNPHTNFTVPTVWGSTVQVSWLALIQRGGGCTFADKIHLAYERGASGAVIFNFPGTRNEVIPMSHPGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 74748 - protein, 402 aa, Homo sapiens
  Payload ID: 14771
  Gene Symbol: RNF128
  Gene Name: ring finger protein 128, E3 ubiquitin protein ligase
  Uniprot ID: Q8TEB7
  ENSP ID: ENSP00000316127
MNQENRSSFFWLLVIFTFLLKITASFSMSAYVTVTYYNETSNYTAIETCECGVYGLASPVANAMGVVGIPKNNNYQACDHNTEFSNTKKPWIALIERGNCTFSEKIQTAGRRNADAVVIYNAPETGNQTIQMANFGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 74749 - protein, 249 aa, Homo sapiens
  Payload ID: 14771
  Gene Symbol: RNF128
  Gene Name: ring finger protein 128, E3 ubiquitin protein ligase
  ENSP ID: ENSP00000412610
MSAYVTVTYYNETSNYTAIETCECGVYGLASPVANAMGVVGIPKNNNYQACDHNTEFSNTKKPWIALIERGNCTFSEKIQTAGRRNADAVVIYNAPETGNQTIQMANFGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKT

SEQ ID NO: 74750 - protein, 381 aa, Homo sapiens
  Payload ID: 14772
  Gene Symbol: RNF13
  Gene Name: ring finger protein 13
  Uniprot ID: O43567
  ENSP ID: ENSP00000341361
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 74751 - protein, 262 aa, Homo sapiens
  Payload ID: 14772
  Gene Symbol: RNF13
  Gene Name: ring finger protein 13
  Uniprot ID: O43567
  ENSP ID: ENSP00000355268
MLILMTSLAWDPTTVSTVEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 74752 - protein, 381 aa, Homo sapiens; identical to SEQ ID NO: 74750
  Payload ID: 14772
  Gene Symbol: RNF13
  Gene Name: ring finger protein 13
  Uniprot ID: O43567
  ENSP ID: ENSP00000376628

SEQ ID NO: 74753 - protein, 192 aa, Homo sapiens
  Payload ID: 14772
  Gene Symbol: RNF13
  Gene Name: ring finger protein 13
  ENSP ID: ENSP00000417294
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDSKYRGHLILVPEFSLPLEYYLIPFLIIVGICLILIVIFMITKFVQDRHRARRNRLR

SEQ ID NO: 74754 - protein, 163 aa, Homo sapiens
  Payload ID: 14772
  Gene Symbol: RNF13
  Gene Name: ring finger protein 13
  ENSP ID: ENSP00000417655
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFT

SEQ ID NO: 74755 - protein, 150 aa, Homo sapiens
  Payload ID: 14772
  Gene Symbol: RNF13
  Gene Name: ring finger protein 13
  ENSP ID: ENSP00000418308
MLILMTSLAWDPTTVSTVEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDP

SEQ ID NO: 74756 - protein, 232 aa, Homo sapiens
  Payload ID: 14772
  Gene Symbol: RNF13
  Gene Name: ring finger protein 13
  ENSP ID: ENSP00000418863
MLILMTSLAWDPTTVSTVEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDS

SEQ ID NO: 74757 - protein, 165 aa, Homo sapiens
  Payload ID: 14772
  Gene Symbol: RNF13
  Gene Name: ring finger protein 13
  ENSP ID: ENSP00000419069
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYE

SEQ ID NO: 74758 - protein, 72 aa, Homo sapiens
  Payload ID: 14772
  Gene Symbol: RNF13
  Gene Name: ring finger protein 13
  ENSP ID: ENSP00000419508
MLLSIGMLMLSATQVYTILTVQLFAFLNLLPVEADILAYNFENASQTFDDLPARFGYRLPAEGLKGFLINSK

SEQ ID NO: 74759 - protein, 17 aa, Homo sapiens
  Payload ID: 14772
  Gene Symbol: RNF13
  Gene Name: ring finger protein 13
  ENSP ID: ENSP00000419809
MLILMTSLAWDPTTLRY

SEQ ID NO: 74760 - protein, 80 aa, Homo sapiens
  Payload ID: 14772
  Gene Symbol: RNF13
  Gene Name: ring finger protein 13
  ENSP ID: ENSP00000419836
MLLSIGMLMLSATQVYTILTVQLFAFLNLLPVEADILAYNFENASQTFDDLPARFGYRLPAEGLKGFLINSKPENACEPI

SEQ ID NO: 74761 - protein, 115 aa, Homo sapiens
  Payload ID: 14772
  Gene Symbol: RNF13
  Gene Name: ring finger protein 13
  ENSP ID: ENSP00000420067
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAG

SEQ ID NO: 74762 - protein, 140 aa, Homo sapiens
  Payload ID: 14772
  Gene Symbol: RNF13
  Gene Name: ring finger protein 13
  ENSP ID: ENSP00000420124
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDSKYS

SEQ ID NO: 74763 - protein, 183 aa, Homo sapiens
  Payload ID: 14772
  Gene Symbol: RNF13
  Gene Name: ring finger protein 13
  ENSP ID: ENSP00000420510
  MOD_RES (1)..(1): Any amino acid
XVPEFSLPLEYYLIPFLIIVGICLILIVIFMITKFVQDRHRARRNRLRKDQLKKLPVHKFKKAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 74764 - protein, 233 aa, Homo sapiens
  Payload ID: 14772
  Gene Symbol: RNF13
  Gene Name: ring finger protein 13
  ENSP ID: ENSP00000420667
MLILMTSLAWDPTTVSTVEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSS

SEQ ID NO: 74765 - protein, 384 aa, Homo sapiens
  Payload ID: 14773
  Gene Symbol: RNF130
  Gene Name: ring finger protein 130
  Uniprot ID: Q86XS8
  ENSP ID: ENSP00000261947
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTR

SEQ ID NO: 74766 - protein, 419 aa, Homo sapiens
  Payload ID: 14773
  Gene Symbol: RNF130
  Gene Name: ring finger protein 130
  ENSP ID: ENSP00000429509
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTSGHFFHRNSLSPRSLVYESEFSTIEPSLDMYDENKT

SEQ ID NO: 74767 - protein, 419 aa, Homo sapiens
  Payload ID: 14773
  Gene Symbol: RNF130
  Gene Name: ring finger protein 130
  Uniprot ID: Q86XS8
  ENSP ID: ENSP00000430237
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 74768 - protein, 141 aa, Homo sapiens
  Payload ID: 14773
  Gene Symbol: RNF130
  Gene Name: ring finger protein 130
  ENSP ID: ENSP00000430999
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEN

SEQ ID NO: 74769 - protein, 376 aa, Homo sapiens
  Payload ID: 14774
  Gene Symbol: RNF133
  Gene Name: ring finger protein 133
  Uniprot ID: Q8WVZ7
  ENSP ID: ENSP00000344489
MHLLKVGTWRNNTASSWLMKFSVLWLVSQNCCRASVVWMAYMNISFHVGNHVLSELGETGVFGRSSTLKRVAGVIVPPEGKIQNACNPNTIFSRSKYSETWLALIERGGCTFTQKIKVATEKGASGVIIYNVPGTGNQVFPMFHQAFEDVVVVMIGNLKGTEIFHLIKKGVLITAVVEVGRKHIIWMNHYLVSFVIVTTATLAYFIFYHIHRLCLARIQNRRWQRLTTDLQNTFGQLQLRVVKEGDEEINPNGDSCVICFERYKPNDIVRILTCKHFFHKNCIDPWILPHGTCPICKCDILKVLGIQVVVENGTEPLQVLMSNELPETLSPSEEETNNEVSPAGTSDKVIHVEENPTSQNNDIQPHSVVEDVHPSP

SEQ ID NO: 74770 - protein, 210 aa, Homo sapiens
  Payload ID: 14775
  Gene Symbol: RNF135
  Gene Name: ring finger protein 135
  Uniprot ID: Q8IUD6
  ENSP ID: ENSP00000323693
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKENSWKPRLPPHAHCLTRATLHSGELLGLLSGPSIQPLT

SEQ ID NO: 74771 - protein, 432 aa, Homo sapiens
  Payload ID: 14775
  Gene Symbol: RNF135
  Gene Name: ring finger protein 135
  Uniprot ID: Q8IUD6
  ENSP ID: ENSP00000328340
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKAFSSGVDLSMASPKLVTSDTAAGKIRDILHDLEEIQEKLQESVTWKEAPEAQMQGELLEAPSSSSCPLPDQSHPALRRASRFAQWAIHPTFNLKSLSCSLEVSKDSRTVTVSHRPQPYRWSCERFSTSQVLCSQALSSGKHYWEVDTRNCSHWAVGVASWEMSRDQVLGRTMDSCCVEWKGTSQLSAWHMVKETVLGSDRPGVVGIWLNLEEGKLAFYSVDNQEKLLYECTISASSPLYPAFWLYGLHPGNYLIIKQVKV

SEQ ID NO: 74772 - protein, 162 aa, Homo sapiens
  Payload ID: 14775
  Gene Symbol: RNF135
  Gene Name: ring finger protein 135
  ENSP ID: ENSP00000411965
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRENSWKPRLPPHAHCLTRATLHSGELLGLLSGPSIQPLT

SEQ ID NO: 74773 - protein, 286 aa, Homo sapiens
  Payload ID: 14775
  Gene Symbol: RNF135
  Gene Name: ring finger protein 135
  Uniprot ID: Q8IUD6
  ENSP ID: ENSP00000440470
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKAFSSGVDLSMASPKLVTSDTAAGKIRDILHDLEEIQEKLQESVTWKEAPEAQMQGSLLPRLECSGTITAASISQAQENSWKPRLPPHAHCLTRATLHSGELLGLLSGPSIQPLT

SEQ ID NO: 74774 - protein, 158 aa, Homo sapiens
  Payload ID: 14775
  Gene Symbol: RNF135
  Gene Name: ring finger protein 135
  ENSP ID: ENSP00000464549
  MOD_RES (1)..(1): Any amino acid
XCQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRAFSSGVDLSMASPKLVTSDTAAGKIRDILHDLEEIQEKLQESVTWKEAPEAQMQGE

SEQ ID NO: 74775 - protein, 86 aa, Homo sapiens
  Payload ID: 14775
  Gene Symbol: RNF135
  Gene Name: ring finger protein 135
  ENSP ID: ENSP00000467799
  MOD_RES (1)..(1): Any amino acid
XKEAPEAQMQGSLLPRLECSGTITAASISQAQENSWKPRLPPHAHCLTRATLHSGELLGLLSVPPRGELIAKAKQVETLDPRALRV

SEQ ID NO: 74776 - protein, 151 aa, Homo sapiens
  Payload ID: 14776
  Gene Symbol: RNF138
  Gene Name: ring finger protein 138, E3 ubiquitin protein ligase
  Uniprot ID: Q8WVD3
  ENSP ID: ENSP00000257190
MAEDLSAATSYTEDDFYCPVCQEVLKTPVRTTACQHVNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 74777 - protein, 245 aa, Homo sapiens
  Payload ID: 14776
  Gene Symbol: RNF138
  Gene Name: ring finger protein 138, E3 ubiquitin protein ligase
  Uniprot ID: Q8WVD3
  ENSP ID: ENSP00000261593
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKYQDEYGVSSIIPNFQISQDSVGNSNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 74778 - protein, 80 aa, Homo sapiens
  Payload ID: 14776
  Gene Symbol: RNF138
  Gene Name: ring finger protein 138, E3 ubiquitin protein ligase
  ENSP ID: ENSP00000462165
MRESGAHCPLCRGNVTRRERACPERALDLENIMRKFSGSCRCCAKQIKFYRMRHHYKSCKKYQDEYGVSSIIPNFQISQD

SEQ ID NO: 74779 - protein, 108 aa, Homo sapiens
  Payload ID: 14776
  Gene Symbol: RNF138
  Gene Name: ring finger protein 138, E3 ubiquitin protein ligase
  ENSP ID: ENSP00000462498
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKY

SEQ ID NO: 74780 - protein, 142 aa, Homo sapiens
  Payload ID: 14776
  Gene Symbol: RNF138
  Gene Name: ring finger protein 138, E3 ubiquitin protein ligase
  ENSP ID: ENSP00000463153
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKYQDEYGVSSIIPNFQISQDSVGNSSSGHPTFKCPL

SEQ ID NO: 74781 - protein, 66 aa, Homo sapiens
  Payload ID: 14776
  Gene Symbol: RNF138
  Gene Name: ring finger protein 138, E3 ubiquitin protein ligase
  ENSP ID: ENSP00000463659
SETSTSDNTETYQENTSSSGHPTFKCPLCQESNFTRQRLLDHCNSNHLFQIVPVILARLPEISLVI

SEQ ID NO: 74782 - protein, 664 aa, Homo sapiens
  Payload ID: 14777
  Gene Symbol: RNF139
  Gene Name: ring finger protein 139
  Uniprot ID: Q8WU17
  ENSP ID: ENSP00000304051
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 74783 - protein, 68 aa, Homo sapiens
  Payload ID: 14777
  Gene Symbol: RNF139
  Gene Name: ring finger protein 139
  ENSP ID: ENSP00000429836
MALIVLQLTFGIGYVTLLQIHSIYSQLIILDLLVPVIGLITELPLHIRETLLFTSSLILTLNTVFVLA

SEQ ID NO: 74784 - protein, 474 aa, Homo sapiens
  Payload ID: 14778
  Gene Symbol: RNF14
  Gene Name: ring finger protein 14
  Uniprot ID: Q9UBS8
  ENSP ID: ENSP00000324956
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 74785 - protein, 474 aa, Homo sapiens; identical to SEQ ID NO: 74784
  Payload ID: 14778
  Gene Symbol: RNF14
  Gene Name: ring finger protein 14
  Uniprot ID: Q9UBS8
  ENSP ID: ENSP00000348462

SEQ ID NO: 74786 - protein, 348 aa, Homo sapiens
  Payload ID: 14778
  Gene Symbol: RNF14
  Gene Name: ring finger protein 14
  Uniprot ID: Q9UBS8
  ENSP ID: ENSP00000378022
MQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 74787 - protein, 474 aa, Homo sapiens; identical to SEQ ID NO: 74784
  Payload ID: 14778
  Gene Symbol: RNF14
  Gene Name: ring finger protein 14
  Uniprot ID: Q9UBS8
  ENSP ID: ENSP00000378027

SEQ ID NO: 74788 - protein, 474 aa, Homo sapiens; identical to SEQ ID NO: 74784
  Payload ID: 14778
  Gene Symbol: RNF14
  Gene Name: ring finger protein 14
  Uniprot ID: Q9UBS8
  ENSP ID: ENSP00000378028

SEQ ID NO: 74789 - protein, 171 aa, Homo sapiens
  Payload ID: 14778
  Gene Symbol: RNF14
  Gene Name: ring finger protein 14
  ENSP ID: ENSP00000420837
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGG

SEQ ID NO: 74790 - protein, 99 aa, Homo sapiens
  Payload ID: 14778
  Gene Symbol: RNF14
  Gene Name: ring finger protein 14
  ENSP ID: ENSP00000421780
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLS

SEQ ID NO: 74791 - protein, 185 aa, Homo sapiens
  Payload ID: 14778
  Gene Symbol: RNF14
  Gene Name: ring finger protein 14
  ENSP ID: ENSP00000422527
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDE

SEQ ID NO: 74792 - protein, 64 aa, Homo sapiens
  Payload ID: 14778
  Gene Symbol: RNF14
  Gene Name: ring finger protein 14
  ENSP ID: ENSP00000422650
MSSEDREAQEDELLALASIYDGDEFRKAESVQGGETRIYLDLPQNFKIFVSGQRVSGSRVICPL

SEQ ID NO: 74793 - protein, 132 aa, Homo sapiens
  Payload ID: 14778
  Gene Symbol: RNF14
  Gene Name: ring finger protein 14
  ENSP ID: ENSP00000423273
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKE

SEQ ID NO: 74794 - protein, 61 aa, Homo sapiens
  Payload ID: 14778
  Gene Symbol: RNF14
  Gene Name: ring finger protein 14
  ENSP ID: ENSP00000423294
MSSEDREAQEDELLALASIYDGDEFRKAESVQGGETRIYLDLPQNFKIFVSGNSNECLQNS

SEQ ID NO: 74795 - protein, 278 aa, Homo sapiens
  Payload ID: 14778
  Gene Symbol: RNF14
  Gene Name: ring finger protein 14
  ENSP ID: ENSP00000423420
MSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQ

SEQ ID NO: 74796 - protein, 15 aa, Homo sapiens
  Payload ID: 14778
  Gene Symbol: RNF14
  Gene Name: ring finger protein 14
  ENSP ID: ENSP00000425361
MSSEDREAQEDELLA

SEQ ID NO: 74797 - protein, 152 aa, Homo sapiens
  Payload ID: 14778
  Gene Symbol: RNF14
  Gene Name: ring finger protein 14
  ENSP ID: ENSP00000426832
MSSEDREAQEDELLALASIYDGDEFRKAESVQGGETRIYLDLPQNFKIFVSEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFN

SEQ ID NO: 74798 - protein, 230 aa, Homo sapiens
  Payload ID: 14779
  Gene Symbol: RNF141
  Gene Name: ring finger protein 141
  Uniprot ID: Q8WVD5
  ENSP ID: ENSP00000265981
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKWSDRHRNCPICRLQMTGANESWVVSDAPTEDDMANYILNMADEAGQPHRP

SEQ ID NO: 74799 - protein, 181 aa, Homo sapiens
  Payload ID: 14779
  Gene Symbol: RNF141
  Gene Name: ring finger protein 141
  ENSP ID: ENSP00000434320
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKW

SEQ ID NO: 74800 - protein, 180 aa, Homo sapiens
  Payload ID: 14779
  Gene Symbol: RNF141
  Gene Name: ring finger protein 141
  ENSP ID: ENSP00000435086
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDK

SEQ ID NO: 74801 - protein, 52 aa, Homo sapiens
  Payload ID: 14779
  Gene Symbol: RNF141
  Gene Name: ring finger protein 141
  ENSP ID: ENSP00000437167
MGQQISDQTQLVINKLPEKVAKHVTLVRESGSLTYEEFLGRVAELNDVTGYF

SEQ ID NO: 74802 - protein, 292 aa, Homo sapiens
  Payload ID: 14780
  Gene Symbol: RNF144A
  Gene Name: ring finger protein 144A
  Uniprot ID: P50876
  ENSP ID: ENSP00000321330
MTTTRYRPTWDLALDPLVSCKLCLGEYPVEQMTTIAQCQCIFCTLCLKQYVELLIKEGLETAISCPDAACPKQGHLQENEIECMVAAEIMQRYKKLQFEREVLFDPCRTWCPASTCQAVCQLQDVGLQTPQPVQCKACRMEFCSTCKASWHPGQGCPETMPITFLPGETSAAFKMEEDDAPIKRCPKCKVYIERDEGCAQMMCKNCKHAFCWYCLESLDDDFLLIHYDKGPCRNKLGHSRASVIWHRTQVVGIFAGFGLLLLVASPFLLLATPFVLCCKCKCSKGDDDPLPT

SEQ ID NO: 74803 - protein, 55 aa, Homo sapiens
  Payload ID: 14780
  Gene Symbol: RNF144A
  Gene Name: ring finger protein 144A
  ENSP ID: ENSP00000402645
MTTTRYRPTWDLALDPLVSCKLCLGEYPVEQMTTIAQCQCIFCTLCLKQYVELLI

SEQ ID NO: 74804 - protein, 264 aa, Homo sapiens
  Payload ID: 14780
  Gene Symbol: RNF144A
  Gene Name: ring finger protein 144A
  ENSP ID: ENSP00000411616
  MOD_RES (1)..(1): Any amino acid
XYRPTWDLALDPLVSCKLCLGEYPVEQMTTIAQCQCIFCTLCLKQYVELLIKEGLETAISCPDAACPKQGHLQENEIECMVAAEIMQRYKKLQFEREVLFDPCRTWCPASTCQAVCQLQDVGLQTPQPVQCKACRMEFCSTCKASWHPGQGCPETMPITFLPGETSAAFKMEEDDAPIKRCPKCKVYIERDEGCAQMMCKNCKHAFCWYCLESLDDDFLLIHYDKGPCRNKLGHSRASVIWHRTQGDAILEKCILHNTESECHL

SEQ ID NO: 74805 - protein, 55 aa, Homo sapiens; identical to SEQ ID NO: 74803
  Payload ID: 14780
  Gene Symbol: RNF144A
  Gene Name: ring finger protein 144A
  ENSP ID: ENSP00000414420

SEQ ID NO: 74806 - protein, 303 aa, Homo sapiens
  Payload ID: 14781
  Gene Symbol: RNF144B
  Gene Name: ring finger protein 144B
  Uniprot ID: Q7Z419
  ENSP ID: ENSP00000259939
MGSAGRLHYLAMTAENPTPGDLAPAPLITCKLCLCEQSLDKMTTLQECQCIFCTACLKQYMQLAIREGCGSPITCPDMVCLNHGTLQEAEIACLVPVDQFQLYQRLKFEREVHLDPYRTWCPVADCQTVCPVASSDPGQPVLVECPSCHLKFCSCCKDAWHAEVSCRDSQPIVLPTEHRALFGTDAEAPIKQCPVCRVYIERNEGCAQMMCKNCKHTFCWYCLQNLDNDIFLRHYDKGPCRNKLGHSRASVMWNRTQVVGILVGLGIIALVTSPLLLLASPCIICCVCKSCRGKKKKHDPSTT

SEQ ID NO: 74807 - protein, 691 aa, Homo sapiens
  Payload ID: 14782
  Gene Symbol: RNF145
  Gene Name: ring finger protein 145
  Uniprot ID: Q96MT1
  ENSP ID: ENSP00000274542
MMRNHRIASSLCGDQVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 74808 - protein, 663 aa, Homo sapiens
  Payload ID: 14782
  Gene Symbol: RNF145
  Gene Name: ring finger protein 145
  Uniprot ID: Q96MT1
  ENSP ID: ENSP00000409064
MAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 74809 - protein, 677 aa, Homo sapiens
  Payload ID: 14782
  Gene Symbol: RNF145
  Gene Name: ring finger protein 145
  Uniprot ID: Q96MT1
  ENSP ID: ENSP00000429071
MVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 74810 - protein, 663 aa, Homo sapiens; identical to SEQ ID NO: 74808
  Payload ID: 14782
  Gene Symbol: RNF145
  Gene Name: ring finger protein 145
  Uniprot ID: Q96MT1
  ENSP ID: ENSP00000430397

SEQ ID NO: 74811 - protein, 680 aa, Homo sapiens
  Payload ID: 14782
  Gene Symbol: RNF145
  Gene Name: ring finger protein 145
  Uniprot ID: Q96MT1
  ENSP ID: ENSP00000430753
MAEVVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 74812 - protein, 693 aa, Homo sapiens
  Payload ID: 14782
  Gene Symbol: RNF145
  Gene Name: ring finger protein 145
  Uniprot ID: Q96MT1
  ENSP ID: ENSP00000430955
MHRDRISPSNSPTWSLQVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 74813 - protein, 663 aa, Homo sapiens; identical to SEQ ID NO: 74808
  Payload ID: 14782
  Gene Symbol: RNF145
  Gene Name: ring finger protein 145
  Uniprot ID: Q96MT1
  ENSP ID: ENSP00000482720

SEQ ID NO: 74814 - protein, 358 aa, Homo sapiens
  Payload ID: 14783
  Gene Symbol: RNF146
  Gene Name: ring finger protein 146
  Uniprot ID: Q9NTX7
  ENSP ID: ENSP00000309365
MAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLENMVQYRRNEHGRRRKIKRDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 74815 - protein, 40 aa, Homo sapiens
  Payload ID: 14783
  Gene Symbol: RNF146
  Gene Name: ring finger protein 146
  ENSP ID: ENSP00000349253
MGSSIFMLFSPLVLYDCYLYEALVITKHFFCPFLPELCKL

SEQ ID NO: 74816 - protein, 359 aa, Homo sapiens
  Payload ID: 14783
  Gene Symbol: RNF146
  Gene Name: ring finger protein 146
  Uniprot ID: Q9NTX7
  ENSP ID: ENSP00000357297
MMAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLENMVQYRRNEHGRRRKIKRDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 74817 - protein, 42 aa, Homo sapiens
  Payload ID: 14783
  Gene Symbol: RNF146
  Gene Name: ring finger protein 146
  ENSP ID: ENSP00000476424
MCWGSSIFMLFSPLVLYDCYLYEALVITKHFFCPFLPELCKL

SEQ ID NO: 74818 - protein, 359 aa, Homo sapiens; identical to SEQ ID NO: 74816
  Payload ID: 14783
  Gene Symbol: RNF146
  Gene Name: ring finger protein 146
  Uniprot ID: Q9NTX7
  ENSP ID: ENSP00000476814

SEQ ID NO: 74819 - protein, 42 aa, Homo sapiens; identical to SEQ ID NO: 74817
  Payload ID: 14783
  Gene Symbol: RNF146
  Gene Name: ring finger protein 146
  ENSP ID: ENSP00000476867

SEQ ID NO: 74820 - protein, 9 aa, Homo sapiens
  Payload ID: 14783
  Gene Symbol: RNF146
  Gene Name: ring finger protein 146
  ENSP ID: ENSP00000476888
MAGCGEIDH

SEQ ID NO: 74821 - protein, 42 aa, Homo sapiens; identical to SEQ ID NO: 74817
  Payload ID: 14783
  Gene Symbol: RNF146
  Gene Name: ring finger protein 146
  ENSP ID: ENSP00000477019

SEQ ID NO: 74822 - protein, 358 aa, Homo sapiens; identical to SEQ ID NO: 74814
  Payload ID: 14783
  Gene Symbol: RNF146
  Gene Name: ring finger protein 146
  Uniprot ID: Q9NTX7
  ENSP ID: ENSP00000477168

SEQ ID NO: 74823 - protein, 40 aa, Homo sapiens; identical to SEQ ID NO: 74815
  Payload ID: 14783
  Gene Symbol: RNF146
  Gene Name: ring finger protein 146
  ENSP ID: ENSP00000477204

SEQ ID NO: 74824 - protein, 14 aa, Homo sapiens
  Payload ID: 14783
  Gene Symbol: RNF146
  Gene Name: ring finger protein 146
  ENSP ID: ENSP00000477440
MCWGSSIFMLFSPL

SEQ ID NO: 74825 - protein, 359 aa, Homo sapiens; identical to SEQ ID NO: 74816
  Payload ID: 14783
  Gene Symbol: RNF146
  Gene Name: ring finger protein 146
  Uniprot ID: Q9NTX7
  ENSP ID: ENSP00000479890

SEQ ID NO: 74826 - protein, 305 aa, Homo sapiens
  Payload ID: 14784
  Gene Symbol: RNF148
  Gene Name: ring finger protein 148
  Uniprot ID: Q8N7C7
  ENSP ID: ENSP00000388207
MSFLRITPSTHSSVSSGLLRLSIFLLLSFPDSNGKAIWTAHLNITFQVGNEITSELGESGVFGNHSPLERVSGVVALPEGWNQNACHPLTNFSRPKQADSWLALIERGGCTFTHKINVAAEKGANGVIIYNYQGTGSKVFPMSHQGTENIVAVMISNLKGMEILHSIQKGVYVTVIIEVGRMHMQWVSHYIMYLFTFLAATIAYFYLDCVWRLTPRVPNSFTRRRSQIKTDVKKAIDQLQLRVLKEGDEELDLNEDNCVVCFDTYKPQDVVRILTCKHFFHKACIDPWLLAHRTCPMCKCDILKT

SEQ ID NO: 74827 - protein, 101 aa, Homo sapiens
  Payload ID: 14784
  Gene Symbol: RNF148
  Gene Name: ring finger protein 148
  ENSP ID: ENSP00000412846
MSFLRITPSTHSSVSSGLLRLSIFLLLSFPDSNGKAIWTAHLNITFQGTENIVAVMISNLKGMEILHSIQKGVYVTVIIEVGRMHMQWEAKSNKDRCEESY

SEQ ID NO: 74828 - protein, 400 aa, Homo sapiens
  Payload ID: 14785
  Gene Symbol: RNF149
  Gene Name: ring finger protein 149
  Uniprot ID: Q8NC42
  ENSP ID: ENSP00000295317
MAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDDSSPPSASPAESEPQCDPSFKGDAGENTALLEAGRSDSRHGGPIS

SEQ ID NO: 74829 - protein, 398 aa, Homo sapiens
  Payload ID: 14785
  Gene Symbol: RNF149
  Gene Name: ring finger protein 149
  ENSP ID: ENSP00000399090
MAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDDSSPPSASPAESEPQCDPSFKGDAGENTALLGAMCSHVMWTSI

SEQ ID NO: 74830 - protein, 396 aa, Homo sapiens
  Payload ID: 14786
  Gene Symbol: RNF150
  Gene Name: ring finger protein 150
  Uniprot ID: Q9ULK6
  ENSP ID: ENSP00000304321
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 74831 - protein, 297 aa, Homo sapiens
  Payload ID: 14786
  Gene Symbol: RNF150
  Gene Name: ring finger protein 150
  Uniprot ID: Q9ULK6
  ENSP ID: ENSP00000394581
MSSHAQPLKLISPCPYSLSSGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 74832 - protein, 405 aa, Homo sapiens
  Payload ID: 14786
  Gene Symbol: RNF150
  Gene Name: ring finger protein 150
  Uniprot ID: Q9ULK6
  ENSP ID: ENSP00000425568
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEFCHT

SEQ ID NO: 74833 - protein, 438 aa, Homo sapiens
  Payload ID: 14786
  Gene Symbol: RNF150
  Gene Name: ring finger protein 150
  Uniprot ID: Q9ULK6
  ENSP ID: ENSP00000425840
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 74834 - protein, 230 aa, Homo sapiens
  Payload ID: 14786
  Gene Symbol: RNF150
  Gene Name: ring finger protein 150
  ENSP ID: ENSP00000425947
MIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTN

SEQ ID NO: 74835 - protein, 244 aa, Homo sapiens
  Payload ID: 14787
  Gene Symbol: RNF151
  Gene Name: ring finger protein 151
  ENSP ID: ENSP00000325794
GGGYDLNLFASPPDSNFVCSVCHGVLKRPARLPCSHIFCKKCILRWLARQKTCPCCRKEVKRKKVVHMNKLRKTIGRLEVKCKNADAGCIVTCPLAHRKGHQDSCPFELTACPNEGCTSQVPRGTLAEHRQHCQQGSQQRCPLGCGATLDPAERARHNCYRELHNAWSVRQERRRPLLLSLLRRVRWLDQATSVVRRELAELSNFLEEDTALLEGAPQEEAEAAPEGNVGAEVVGEPRANIPCK

SEQ ID NO: 74836 - protein, 90 aa, Homo sapiens
  Payload ID: 14787
  Gene Symbol: RNF151
  Gene Name: ring finger protein 151
  ENSP ID: ENSP00000454886
MGGGYDLNLFASPPDSNFVCSVCHGVLKRPARLPCSHIFCKKCILRWLARGGAGLGEKAGESHLQRETSAALGRPDIAEFGSWLYCLVAV

SEQ ID NO: 74837 - protein, 245 aa, Homo sapiens
  Payload ID: 14787
  Gene Symbol: RNF151
  Gene Name: ring finger protein 151
  Uniprot ID: Q2KHN1
  ENSP ID: ENSP00000456566
MGGGYDLNLFASPPDSNFVCSVCHGVLKRPARLPCSHIFCKKCILRWLARQKTCPCCRKEVKRKKVVHMNKLRKTIGRLEVKCKNADAGCIVTCPLAHRKGHQDSCPFELTACPNEGCTSQVPRGTLAEHRQHCQQGSQQRCPLGCGATLDPAERARHNCYRELHNAWSVRQERRRPLLLSLLRRVRWLDQATSVVRRELAELSNFLEEDTALLEGAPQEEAEAAPEGNVGAEVVGEPRANIPCK

SEQ ID NO: 74838 - protein, 203 aa, Homo sapiens
  Payload ID: 14788
  Gene Symbol: RNF152
  Gene Name: ring finger protein 152
  Uniprot ID: Q8N8N0
  ENSP ID: ENSP00000316628
METLSQDSLLECQICFNYYSPRRRPKLLDCKHTCCSVCLQQMRTSQKDVRCPWCRGVTKLPPGFSVSQLPDDPEVLAVIAIPHTSEHTPVFIKLPSNGCYMLPLPISKERALLPGDMGCRLLPGSQQKSVTVVTIPAEQQPLQGGAPQEAVEEEQDRRGVVKSSTWSGVCTVILVACVLVFLLGIVLHNMSCISKRFTVISCG

SEQ ID NO: 74839 - protein, 114 aa, Homo sapiens
  Payload ID: 14788
  Gene Symbol: RNF152
  Gene Name: ring finger protein 152
  ENSP ID: ENSP00000466492
METLSQDSLLECQICFNYYSPRRRPKLLDCKHTCCSVCLQQMRTSQKDVRCPWCRGVTKLPPGFSVSQLPDDPEVLAVIAIPHTSEHTPVFIKLPSNGCYMLPLPISKERALLP

SEQ ID NO: 74840 - protein, 679 aa, Homo sapiens
  Payload ID: 14789
  Gene Symbol: RNF157
  Gene Name: ring finger protein 157
  Uniprot ID: Q96PX1
  ENSP ID: ENSP00000269391
MGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 74841 - protein, 657 aa, Homo sapiens
  Payload ID: 14789
  Gene Symbol: RNF157
  Gene Name: ring finger protein 157
  Uniprot ID: Q96PX1
  ENSP ID: ENSP00000321837
MGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 74842 - protein, 72 aa, Homo sapiens
  Payload ID: 14789
  Gene Symbol: RNF157
  Gene Name: ring finger protein 157
  ENSP ID: ENSP00000465543
MGALTSRQHAGVEEVDIPSNSVYRYPPKSGSYFASHFIMGGEKFDSTHPEGYLFGENSDLNFLGNRPVVVWL

SEQ ID NO: 74843 - protein, 81 aa, Homo sapiens
  Payload ID: 14789
  Gene Symbol: RNF157
  Gene Name: ring finger protein 157
  ENSP ID: ENSP00000467096
  MOD_RES (1)..(1): Any amino acid
XKRGVCQQFCLPSHTVDPSEWAEEELGFDLDREVYPLVVHAVVDEGDEYFGHCHVLLGTFEKHTDGTFCVKPLKQKQVVSI

SEQ ID NO: 74844 - protein, 161 aa, Homo sapiens
  Payload ID: 14789
  Gene Symbol: RNF157
  Gene Name: ring finger protein 157
  ENSP ID: ENSP00000468099
  MOD_RES (1)..(1): Any amino acid
XSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPAAAPESCPINIEE

SEQ ID NO: 74845 - protein, 346 aa, Homo sapiens
  Payload ID: 14790
  Gene Symbol: RNF165
  Gene Name: ring finger protein 165
  Uniprot ID: Q6ZSG1
  ENSP ID: ENSP00000269439
MVLVHVGYLVLPVFGSVRNRGAPFQRSQHPHATSCRHFHLGPPQPQQLAPDFPLAHPVQSQPGLSAHMAPAHQHSGALHQSLTPLPTLQFQDVTGPSFLPQALHQQYLLQQQLLEAQHRRLVSHPRRSQERVSVHPHRLHPSFDFGQLQTPQPRYLAEGTDWDLSVDAGLSPAQFQVRPIPQHYQHYLATPRMHHFPRNSSSTQMVVHEIRNYPYPQLHFLALQGLNPSRHTSAVRESYEELLQLEDRLGNVTRGAVQNTIERFTFPHKYKKRRPQDGKGKKDEGEESDTDEKCTICLSMLEDGEDVRRLPCMHLFHQLCVDQWLAMSKKCPICRVDIETQLGADS

SEQ ID NO: 74846 - protein, 154 aa, Homo sapiens
  Payload ID: 14790
  Gene Symbol: RNF165
  Gene Name: ring finger protein 165
  Uniprot ID: Q6ZSG1
  ENSP ID: ENSP00000444285
MHHFPRNSSSTQMVVHEIRNYPYPQLHFLALQGLNPSRHTSAVRESYEELLQLEDRLGNVTRGAVQNTIERFTFPHKYKKRRPQDGKGKKDEGEESDTDEKCTICLSMLEDGEDVRRLPCMHLFHQLCVDQWLAMSKKCPICRVDIETQLGADS

SEQ ID NO: 74847 - protein, 22 aa, Homo sapiens
  Payload ID: 14790
  Gene Symbol: RNF165
  Gene Name: ring finger protein 165
  ENSP ID: ENSP00000466208
MVLVHVGYLVLPVFGSVRNRAQ

SEQ ID NO: 74848 - protein, 22 aa, Homo sapiens
  Payload ID: 14790
  Gene Symbol: RNF165
  Gene Name: ring finger protein 165
  ENSP ID: ENSP00000466809
MVLVHVGYLVLPVFGSVRNRAQ

SEQ ID NO: 74849 - protein, 68 aa, Homo sapiens
  Payload ID: 14790
  Gene Symbol: RNF165
  Gene Name: ring finger protein 165
  ENSP ID: ENSP00000467609
MVLVHVGYLVLPVFGSVRNRGIAFSFRGLLRSVDRRRHRGGGGRRGRPGAQGTPARTQGERWLPPTPF

SEQ ID NO: 74850 - protein, 156 aa, Homo sapiens
  Payload ID: 14790
  Gene Symbol: RNF165
  Gene Name: ring finger protein 165
  ENSP ID: ENSP00000467730
MAPAHQHSGALHQSLTPLPTLQFQDVTGPSFLPQALHQQYLLQQQLLEAQHRRLVSHPRRSQERVSVHPHRLHPSFDFGQLQTPQPRYLAEGTDWDLSVDAGLSPAQFQVRPIPQHYQHYLATPRMHHFPRNSSSTQMVVHEIRNYPYPQLHFLAL

SEQ ID NO: 74851 - protein, 28 aa, Homo sapiens
  Payload ID: 14790
  Gene Symbol: RNF165
  Gene Name: ring finger protein 165
  ENSP ID: ENSP00000468365
MVLVHVGYLVLPVFGSVRNRGISVWMLA

SEQ ID NO: 74852 - protein, 237 aa, Homo sapiens
  Payload ID: 14791
  Gene Symbol: RNF166
  Gene Name: ring finger protein 166
  Uniprot ID: Q96A37
  ENSP ID: ENSP00000326095
MAMFRSLVASAQQRQPPAGPAGGDSGLEAQYTCPICLEVYHRPVAIGSCGHTFCGECLQPCLQVPSPLCPLCRLPFDPKKVDKATHVEKQLSSYKAPCRGCNKKVTLAKMRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 74853 - protein, 128 aa, Homo sapiens
  Payload ID: 14791
  Gene Symbol: RNF166
  Gene Name: ring finger protein 166
  Uniprot ID: Q96A37
  ENSP ID: ENSP00000440454
MRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 74854 - protein, 128 aa, Homo sapiens; identical to SEQ ID NO: 74853
  Payload ID: 14791
  Gene Symbol: RNF166
  Gene Name: ring finger protein 166
  Uniprot ID: Q96A37
  ENSP ID: ENSP00000446301

SEQ ID NO: 74855 - protein, 148 aa, Homo sapiens
  Payload ID: 14791
  Gene Symbol: RNF166
  Gene Name: ring finger protein 166
  ENSP ID: ENSP00000455539
GGDSGLEAQYTCPICLEVYHRPVAIGSCGHTFCGECLQPCLQVPSPLCPLCRLPFDPKKVDKATHVEKQLSSYKAPCRGCNKKVTLAKMRVHISSCLKVQEQMANCPKFVPVVPTSQPIPSGGRAWGPGQGPAWRAGQHVNILFCSWH

SEQ ID NO: 74856 - protein, 46 aa, Homo sapiens
  Payload ID: 14791
  Gene Symbol: RNF166
  Gene Name: ring finger protein 166
  ENSP ID: ENSP00000455617
  MOD_RES (1)..(1): Any amino acid
XISSCLKVQEQMANCPKFVPVVPTSQPIPSNIPNRVLALARCHLQS

SEQ ID NO: 74857 - protein, 156 aa, Homo sapiens
  Payload ID: 14791
  Gene Symbol: RNF166
  Gene Name: ring finger protein 166
  Uniprot ID: Q96A37
  ENSP ID: ENSP00000457336
MAMFRSLVASAQQRQPPAGPAGGDSGLEAQYTCPICLEVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 74858 - protein, 165 aa, Homo sapiens
  Payload ID: 14791
  Gene Symbol: RNF166
  Gene Name: ring finger protein 166
  ENSP ID: ENSP00000457374
MRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVVGIPPAPSSPTPSSSTLLLLGPLASLRVRRVQRKPETEASFQVATFPQVLWGLPAGGE

SEQ ID NO: 74859 - protein, 350 aa, Homo sapiens [sequence omitted]

SEQ ID NO: 74860 - protein, 315 aa, Homo sapiens
  Payload ID: 14792
  Gene Symbol: RNF167
  Gene Name: ring finger protein 167
  ENSP ID: ENSP00000458189
MDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 74861 - protein, 97 aa, Homo sapiens
  Payload ID: 14792
  Gene Symbol: RNF167
  Gene Name: ring finger protein 167
  ENSP ID: ENSP00000458375
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLK

SEQ ID NO: 74862 - protein, 350 aa, Homo sapiens [sequence omitted]

SEQ ID NO: 74863 - protein, 71 aa, Homo sapiens
  Payload ID: 14792
  Gene Symbol: RNF167
  Gene Name: ring finger protein 167
  ENSP ID: ENSP00000458905
MDFADLPALFGATLSQEGLQGFLVEAHPDNACSPIAPPPPAPVNGSVFIALLRRFDCNFDLKVLNAQKAGY

SEQ ID NO: 74864 - protein, 350 aa, Homo sapiens [sequence omitted]

SEQ ID NO: 74865 - protein, 122 aa, Homo sapiens
  Payload ID: 14792
  Gene Symbol: RNF167
  Gene Name: ring finger protein 167
  ENSP ID: ENSP00000459581
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNM

SEQ ID NO: 74866 - protein, 208 aa, Homo sapiens
  Payload ID: 14792
  Gene Symbol: RNF167
  Gene Name: ring finger protein 167
  ENSP ID: ENSP00000460024
HNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHGEALTACPCPSATSSHQVLHLVPLCSLPQPLRGPLAHSDPEDLPHLQAACSSGSWGRRPRGRNSRARGG

SEQ ID NO: 74867 - protein, 350 aa, Homo sapiens [sequence omitted]

SEQ ID NO: 74868 - protein, 133 aa, Homo sapiens
  Payload ID: 14792
  Gene Symbol: RNF167
  Gene Name: ring finger protein 167
  ENSP ID: ENSP00000460991
MHPAAFPLPVVVAAVLWGAAPTRGLIRAGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGRPV

SEQ ID NO: 74869 - protein, 74 aa, Homo sapiens
  Payload ID: 14792
  Gene Symbol: RNF167
  Gene Name: ring finger protein 167
  ENSP ID: ENSP00000466753
  MOD_RES (1)..(1): Any amino acid
XEIQQQIWIPSVFIGERSSEYLRALFVYEKGLPQPLRGPLAHSDPEDLPHLQAACSSGSWGRRPRGRNSRARGG

SEQ ID NO: 74870 - protein, 571 aa, Homo sapiens
  Payload ID: 14793
  Gene Symbol: RNF168
  Gene Name: ring finger protein 168, E3 ubiquitin protein ligase
  Uniprot ID: Q8IYW5
  ENSP ID: ENSP00000320898
MALPKDAIPSLSECQCGICMEILVEPVTLPCNHTLCKPCFQSTVEKASLCCPFCRRRVSSWTRYHTRRNSLVNVELWTIIQKHYPRECKLRASGQESEEVADDYQPVRLLSKPGELRREYEEEISKVAAERRASEEEENKASEEYIQRLLAEEEEEEKRQAEKRRRAMEEQLKSDEELARKLSIDINNFCEGSISASPLNSRKSDPVTPKSEKKSKNKQRNTGDIQKYLTPKSQFGSASHSEAVQEVRKDSVSKDIDSSDRKSPTGQDTEIEDMPTLSPQISLGVGEQGADSSIESPMPWLCACGAEWYHEGNVKTRPSNHGKELCVLSHERPKTRVPYSKETAVMPCGRTESGCAPTSGVTQTNGNNTGETENEESCLLISKEISKRKNQESSFEAVKDPCFSAKRRKVSPESSPDQEETEINFTQKLIDLEHLLFERHKQEEQDRLLALQLQKEVDKEQMVPNRQKGSPDEYHLRATSSPPDKVLNGQRKNPKDGNFKRQTHTKHPTPERGSRDKNRQVSLKMQLKQSVNRRKMPNSTRDHCKVSKSAHSLQPSISQKSVFQMFQRCTK

SEQ ID NO: 74871 - protein, 116 aa, Homo sapiens
  Payload ID: 14793
  Gene Symbol: RNF168
  Gene Name: ring finger protein 168, E3 ubiquitin protein ligase
  ENSP ID: ENSP00000396712
MALPKDAIPSLSECQCGICMEILVEPVTLPCNHTLCKPCFQSTVEKASLCCPFCRRRVSSWTRYHTRRNSLVNVELWTIIQKHYPRECKLRASGQESEEVGGGRATGQRGRRKQSQ

SEQ ID NO: 74872 - protein, 708 aa, Homo sapiens
  Payload ID: 14794
  Gene Symbol: RNF169
  Gene Name: ring finger protein 169
  Uniprot ID: Q8NCN4
  ENSP ID: ENSP00000299563
MAAAGPSTRASSAAAAAALSRRGRRGRCDETAAAKTGAPGPASGPSLLVLSPPLLQPPLPPRPEESGCAGCLEPPGEAAALPCGHSLCRGCAQRAADAAGPGCPRCRARGPGWARRRARDDGQADSEVLGECARRSQPERCRPRRDGGAAAAGPRPEQEPRAAPAEPDFIFRAPIKLSKPGELREEYESLRKLREEKLQEEKPSEDQIHKLLPEDTETGKRKMDEQKKRDEPLVLKTNLERCPARLSDSENEEPSRGQMTQTHRSAFVSKNNSYSLAFLAGKLNSKVERSQSCSDTAQERAKSRVRAVPGNKAKVTTMTPASNPIIGVLLSTQNNRCVSAPDLTIEKRLPFSSLSSLASLHKPERSVSPESNDSISEELNHFKPIVCSPCTPPKRLPDGRVLSPLIIKSTPRNLNRSLQKQTSYEASPRILKKWEQIFQERQIKKTLSKATLTSLAPEMGEELLGSEGIHSSKEKPLVAVNTRLSGGQVLSEYTGPTSADLDHFPSVSQTKAEQDSDNKSSTEIPLETCCSSELKGGGSGTSLEREQFEGLGSTPDAKLDKTCISRAMKITTVNSVLPQNSVLGGVLKTKQQLKTLNHFDLTNGVLVESLSEEPLPSLRRGRKRHCKTKHLEQNGSLKKLRQTSGEVGLAPTDPVLREMEQKLQQEEEDRQLALQLQRMFDNERRTVSRRKGSVDQYLLRSSNMAGAK

SEQ ID NO: 74873 - protein, 79 aa, Homo sapiens
  Payload ID: 14794
  Gene Symbol: RNF169
  Gene Name: ring finger protein 169
  ENSP ID: ENSP00000436339
  MOD_RES (1)..(1): Any amino acid
XLEQNGSLKKLRQTSGEVGLAPTDPVLREMEQKLQQEEEDRQLALQLQRMFDNERRTVSRRKGSVDQYLLRSSNMAGAK

SEQ ID NO: 74874 - protein, 1623 aa, Homo sapiens
  Payload ID: 14795
  Gene Symbol: RNF17
  Gene Name: ring finger protein 17
  Uniprot ID: Q9BXT8
  ENSP ID: ENSP00000255324
MAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKFKSQSLRSHFEKNTTLHYHPPILPKEMTDVSVTVCHINSPGDFYLQLIEGLDILFLLKTIEEFYKSEDGENLEILCPVQDQACVAKFEDGIWYRAKVIGLPGHQEVEVKYVDFGNTAKITIKDVRKIKDEFLNAPEKAIKCKLAYIEPYKRTMQWSKEAKEKFEEKAQDKFMTCSVIKILEDNVLLVELFDSLGAPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMELPKNPWEKLSIHLYFDGMSLSYFMAYYKYCTSEHTEEMLKEKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 74875 - protein, 653 aa, Homo sapiens
  Payload ID: 14795
  Gene Symbol: RNF17
  Gene Name: ring finger protein 17
  Uniprot ID: Q9BXT8
  ENSP ID: ENSP00000255325
MAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKDLI

SEQ ID NO: 74876 - protein, 633 aa, Homo sapiens
  Payload ID: 14795
  Gene Symbol: RNF17
  Gene Name: ring finger protein 17
  ENSP ID: ENSP00000344776
MIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLCQIPSHLMRYPARAIKVLLAGFKPPLRDLGETRIPYCPKWSMEALWAMIDCLQGKQLYAVSMAPAPEQIVTLYDDEQHPVHMPLVEMGLADKDE

SEQ ID NO: 74877 - protein, 855 aa, Homo sapiens
  Payload ID: 14795
  Gene Symbol: RNF17
  Gene Name: ring finger protein 17
  ENSP ID: ENSP00000388892
MTDVSVTVCHINSPGDFYLQLIEGLDILFLLKTIEEFYKSEDGENLEILCPVQDQACVAKFEDGIWYRAKVIGLPGHQEVEVKYVDFGNTAKITIKDVRKIKDEFLNAPEKAIKCKLAYIEPYKRTMQWSKEAKEKFEEKAQDKFMTCSVIKILEDNVLLVELFDSLGAPEMTTTSINDQLVKEGLASYEIGYILKDNSQKHIEVWDPSPEEIISNEVHNLNPVSAKSLPNENFQSLYNKELPVHICNVISPEKIYVQWLLTENLLNSLEEKMIAAYENSKWEPVKWENDMHCAVKIQDKNQWRRGQIIRMVTDTLVEVLLYDVGVELVVNVDCLRKLEENLKTMGRLSLECSLVDIRPAGGSDKWTATACDCLSLYLTGAVATIILQVDSEENNTTWPLPVKIFCRDEKGERVDVSKYLIKKGLALRERRINNLDNSHSLSEKSLEVPLEQEDSVVTNCIKTNFDPDKKTADIISEQKVSEFQEKILEPRTTRGYKPPAIPNMNVFEATVSCVGDDGTIFVVPKLSEFELIKMTNEIQSNLKCLGLLEPYFWKKGEACAVRGSDTLWYRGKVMEVVGGAVRVQYLDHGFTEKIPQCHLYPILLYPDIPQFCIPCQLHNTTPVGNVWQPDAIEVLQQLLSKRQVDIHIMELPKNPWEKLSIHLYFDGMSLSYFMAYYKYCTSEHTEEMLKEKPRSDHDKKYEEEQWEIRFEELLSAETDTPLLPPYLSSSLPSPGELYAVQVKHVVSPNEVYICLDSIETSNQSNQHSDTDDSGVSGESESESLDEALQRVNKKVEALPPLTDFRTEMPCLAEYDDGLWYRAKIVAIKEFNPLSILVQFVDYGSTAKLTLNRLKI

SEQ ID NO: 74878 - protein, 116 aa, Homo sapiens
  Payload ID: 14796
  Gene Symbol: RNF170
  Gene Name: ring finger protein 170
  Uniprot ID: Q96K19
  ENSP ID: ENSP00000240159
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGNLTPNSIW

SEQ ID NO: 74879 - protein, 116 aa, Homo sapiens; identical to SEQ ID NO: 74878
  Payload ID: 14796
  Gene Symbol: RNF170
  Gene Name: ring finger protein 170
  Uniprot ID: Q96K19
  ENSP ID: ENSP00000325969

SEQ ID NO: 74880 - protein, 200 aa, Homo sapiens
  Payload ID: 14796
  Gene Symbol: RNF170
  Gene Name: ring finger protein 170
  Uniprot ID: Q96K19
  ENSP ID: ENSP00000326138
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTGSSEKSSRASEQTHQEAVACLDTQNSPACTVGCRSGPQHIPHDRMLPSASPRLCFTLLDCVSILWFSG

SEQ ID NO: 74881 - protein, 258 aa, Homo sapiens
  Payload ID: 14796
  Gene Symbol: RNF170
  Gene Name: ring finger protein 170
  Uniprot ID: Q96K19
  ENSP ID: ENSP00000434797
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 74882 - protein, 174 aa, Homo sapiens
  Payload ID: 14796
  Gene Symbol: RNF170
  Gene Name: ring finger protein 170
  Uniprot ID: Q96K19
  ENSP ID: ENSP00000435782
MYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 74883 - protein, 115 aa, Homo sapiens
  Payload ID: 14796
  Gene Symbol: RNF170
  Gene Name: ring finger protein 170
  ENSP ID: ENSP00000436416
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYW

SEQ ID NO: 74884 - protein, 45 aa, Homo sapiens
  Payload ID: 14796
  Gene Symbol: RNF170
  Gene Name: ring finger protein 170
  ENSP ID: ENSP00000437146
MAKYQGEVQSLKLDDDSVIEGVSDQVLVAVVVSFALIATLVYALF

SEQ ID NO: 74885 - protein, 258 aa, Homo sapiens; identical to SEQ ID NO: 74881
  Payload ID: 14796
  Gene Symbol: RNF170
  Gene Name: ring finger protein 170
  Uniprot ID: Q96K19
  ENSP ID: ENSP00000445725

SEQ ID NO: 74886 - protein, 328 aa, Homo sapiens
  Payload ID: 14797
  Gene Symbol: RNF175
  Gene Name: ring finger protein 175
  Uniprot ID: Q8N4F7
  ENSP ID: ENSP00000340979
MAAGTAARKAAPVLEAPPQQEQLSHTKLSAEDTWNLQQERMYKMHRGHDSMHVEMILIFLCVLVIAQIVLVQWRQRHGRSYNLVTLLQMWVVPLYFTIKLYWWRFLSMWGMFSVITSYILFRATRKPLSGRTPRLVYKWFLLIYKLSYAFGVVGYLAIMFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVFHEFCIRGWCIVGKKQTCPYCKEKVDLKRMISNPWERTHFLYGQILDWLRYLVAWQPVVIGIVQGIIYSLGLE

SEQ ID NO: 74887 - protein, 36 aa, Homo sapiens
  Payload ID: 14797
  Gene Symbol: RNF175
  Gene Name: ring finger protein 175
  ENSP ID: ENSP00000421761
MAAGTAARKAAPVLEAPPQQEQLSHTKLSAEDTWNW

SEQ ID NO: 74888 - protein, 121 aa, Homo sapiens
  Payload ID: 14797
  Gene Symbol: RNF175
  Gene Name: ring finger protein 175
  ENSP ID: ENSP00000424430
MAAGTAARKAAPVLEAPPQQEQLSHTKLSAEDTWNLQQERMYKMHRGHDSMHVEMILIFLCVLVIAQIVLVQWRQRHGRSYNIGLQMVSFDLQTQLCIWCCGLLGDHVYNVWIQSVFQNQS

SEQ ID NO: 74889 - protein, 68 aa, Homo sapiens
  Payload ID: 14797
  Gene Symbol: RNF175
  Gene Name: ring finger protein 175
  ENSP ID: ENSP00000424563
MAAGTAARKAAPVLEAPPQQEQLSHTKLSAEDTWKLRAFSDDLILLVPACSRRGCTRCTGATIPCTWK

SEQ ID NO: 74890 - protein, 150 aa, Homo sapiens
  Payload ID: 14797
  Gene Symbol: RNF175
  Gene Name: ring finger protein 175
  ENSP ID: ENSP00000427472
MAAGTAARKAAPVLEAPPQQEQLVTLLQMWVVPLYFTIKLYWWRFLSMWGMFSVITSYILFRATRKPLSGRTPRLVYKWFLLIYKLSYAFGVVGYLAIMFTMCGFNLFFKIKARDSMDFGIVSLFYGLYYGVMGRDFAEICSDYMASTIG

SEQ ID NO: 74891 - protein, 416 aa, Homo sapiens
  Payload ID: 14798
  Gene Symbol: RNF180
  Gene Name: ring finger protein 180
  Uniprot ID: Q86T96
  ENSP ID: ENSP00000296615
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSCGQLAAVHLSKSRTDYQPTQAGRLMRPSVKYLSHPRVQSGCDKEALLTGGGSENRNHRLLNMARNNNDPGRLTEALCLEVRPTYFEMKNEKLLSKASEPKYQLFVPQLVTGRCATRAFHRKSHSLDLNISEKLTLLPTLYEIHSKTTAYSRLNETQPIDLSGLPLQSSKNSYSFQNPSSFDPSMLLQRFSVAPHETQTQRGGEFQCGLEAASVYSDHTNTNNLTFLMDLPSAGRSMPEASDQEEHLSPLDFLHSANFSLGSINQRLNKRERSKLKNLRRKQRRRERWLQKQGKYSGVGLLDHMVSIYLLI

SEQ ID NO: 74892 - protein, 592 aa, Homo sapiens
  Payload ID: 14798
  Gene Symbol: RNF180
  Gene Name: ring finger protein 180
  Uniprot ID: Q86T96
  ENSP ID: ENSP00000373752
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSCGQLAAVHLSKSRTDYQPTQAGRLMRPSVKYLSHPRVQSGCDKEALLTGGGSENRNHRLLNMARNNNDPGRLTEALCLEVRPTYFEMKNEKLLSKASEPKYQLFVPQLVTGRCATRAFHRKSHSLDLNISEKLTLLPTLYEIHSKTTAYSRLNETQPIDLSGLPLQSSKNSYSFQNPSSFDPSMLLQRFSVAPHETQTQRGGEFQCGLEAASVYSDHTNTNNLTFLMDLPSAGRSMPEASDQEEHLSPLDFLHSANFSLGSINQRLNKRERSKLKNLRRKQRRRERWLQKQGKYSGVGLLDHMTLNNEMSTDEDNEYAEEKDSYICAVCLDVYFNPYMCYPCHHIFCEPCLRTLAKDNPSSTPCPLCRTIISRVFFQTELNNATKTFFTKEYLKIKQSFQKSNSAKWPLPSCRKAFHLFGGFRRHAAPVTRRQFPHGAHRMDYLHFEDDSRGWWFDMDMVIIYIYSVNWVIGFIVFCFLCYFFFPF

SEQ ID NO: 74893 - protein, 107 aa, Homo sapiens
  Payload ID: 14798
  Gene Symbol: RNF180
  Gene Name: ring finger protein 180
  ENSP ID: ENSP00000426884
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSC

SEQ ID NO: 74894 - protein, 153 aa, Homo sapiens
  Payload ID: 14799
  Gene Symbol: RNF181
  Gene Name: ring finger protein 181
  Uniprot ID: Q9P0P0
  ENSP ID: ENSP00000306906
MASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKTNSCPLCRYELPTDDDTYEEHRRDKARKQQQQHRLENLHGAMYT

SEQ ID NO: 74895 - protein, 78 aa, Homo sapiens
  Payload ID: 14799
  Gene Symbol: RNF181
  Gene Name: ring finger protein 181
  ENSP ID: ENSP00000391326
MASYFDEHDCEPSDPEQETRTNMLLELARSLFNRMDFEDLGLVVDWDHHLPPPAAKTVVENLPRTVIRGSQAGGGDCH

SEQ ID NO: 74896 - protein, 103 aa, Homo sapiens
  Payload ID: 14799
  Gene Symbol: RNF181
  Gene Name: ring finger protein 181
  ENSP ID: ENSP00000397109
MASYFDEHDCEPSDPEQETRTNMLLELARSLFNRMDFEDLGLVVDWDHHLPPPAAKTVVENLPRTVIRGSQAVFQVRWGQVSFRSGSLGGRACSSSPDQHSFL

SEQ ID NO: 74897 - protein, 139 aa, Homo sapiens
  Payload ID: 14799
  Gene Symbol: RNF181
  Gene Name: ring finger protein 181
  ENSP ID: ENSP00000412025
MASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKTNSCPLCRYELPTDDDTYEEHRRDKVGADA

SEQ ID NO: 74898 - protein, 170 aa, Homo sapiens
  Payload ID: 14799
  Gene Symbol: RNF181
  Gene Name: ring finger protein 181
  ENSP ID: ENSP00000415246
  MOD_RES (1)..(1): Any amino acid
XTRTNMLLELARSLFNRMDFEDLGLVVDWDHHLPPPAAKTVVENLPRTVIRGSQAALTVPWAQYSSFFLFMDCWGMEEEWQLGAGEGGYQLMKIRPRLEHYSTFLRQIPVPCAAMSCPLMTTLMRSTDEIRLENSSSNTDWRTSMEPCTREEVGAECWPSASSLLTLNPH

SEQ ID NO: 74899 - protein, 51 aa, Homo sapiens
  Payload ID: 14800
  Gene Symbol: RNF182
  Gene Name: ring finger protein 182
  ENSP ID: ENSP00000417500
MASQPPEDTAESQASDELECKICYNRYNLKQRKPKVLECCHRVCAKCLYKI

SEQ ID NO: 74900 - protein, 13 aa, Homo sapiens
  Payload ID: 14800
  Gene Symbol: RNF182
  Gene Name: ring finger protein 182
  ENSP ID: ENSP00000417514
MASQPPEDTAESQ

SEQ ID NO: 74901 - protein, 82 aa, Homo sapiens
  Payload ID: 14800
  Gene Symbol: RNF182
  Gene Name: ring finger protein 182
  ENSP ID: ENSP00000418717
MASQPPEDTAESQASDELECKICYNRYNLKQRKPKVLECCHRVCAKCLYKIIDFGDSPQGVIVCPFCRFETCLPDDEVSSLP

SEQ ID NO: 74902 - protein, 162 aa, Homo sapiens
  Payload ID: 14800
  Gene Symbol: RNF182
  Gene Name: ring finger protein 182
  ENSP ID: ENSP00000419329
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVT

SEQ ID NO: 74903 - protein, 247 aa, Homo sapiens
  Payload ID: 14800
  Gene Symbol: RNF182
  Gene Name: ring finger protein 182
  Uniprot ID: Q8N6D2
  ENSP ID: ENSP00000420465
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVTTVSHNWTVWNCTSLLFQTSIRVLVWLLGLLYFSSLPLGIYLLVSKKVTLGVVFVSLVPSSLVILMVYGFCQCVCHEFLDCMAPPS

SEQ ID NO: 74904 - protein, 247 aa, Homo sapiens; identical to SEQ ID NO: 74903
  Payload ID: 14800
  Gene Symbol: RNF182
  Gene Name: ring finger protein 182
  Uniprot ID: Q8N6D2
  ENSP ID: ENSP00000441271

SEQ ID NO: 74905 - protein, 247 aa, Homo sapiens; identical to SEQ ID NO: 74903
  Payload ID: 14800
  Gene Symbol: RNF182
  Gene Name: ring finger protein 182
  Uniprot ID: Q8N6D2
  ENSP ID: ENSP00000442021

SEQ ID NO: 74906 - protein, 247 aa, Homo sapiens; identical to SEQ ID NO: 74903
  Payload ID: 14800
  Gene Symbol: RNF182
  Gene Name: ring finger protein 182
  Uniprot ID: Q8N6D2
  ENSP ID: ENSP00000443228

SEQ ID NO: 74907 - protein, 192 aa, Homo sapiens
  Payload ID: 14801
  Gene Symbol: RNF183
  Gene Name: ring finger protein 183
  Uniprot ID: Q96D59
  ENSP ID: ENSP00000417176
MAEQQGRELEAECPVCWNPFNNTFHTPKMLDCCHSFCVECLAHLSLVTPARRRLLCPLCRQPTVLASGQPVTDLPTDTAMLALLRLEPHHVILEGHQLCLKDQPKSRYFLRQPQVYTLDLGPQPGGQTGPPPDTASATVSTPILIPSHHSLRECFRNPQFRIFAYLMAVILSVTLLLIFSIFWTKQFLWGVG

SEQ ID NO: 74908 - protein, 192 aa, Homo sapiens; identical to SEQ ID NO: 74907
  Payload ID: 14801
  Gene Symbol: RNF183
  Gene Name: ring finger protein 183
  Uniprot ID: Q96D59
  ENSP ID: ENSP00000417943

SEQ ID NO: 74909 - protein, 192 aa, Homo sapiens; identical to SEQ ID NO: 74907
  Payload ID: 14801
  Gene Symbol: RNF183
  Gene Name: ring finger protein 183
  Uniprot ID: Q96D59
  ENSP ID: ENSP00000419454

SEQ ID NO: 74910 - protein, 192 aa, Homo sapiens; identical to SEQ ID NO: 74907
  Payload ID: 14801
  Gene Symbol: RNF183
  Gene Name: ring finger protein 183
  Uniprot ID: Q96D59
  ENSP ID: ENSP00000420740

SEQ ID NO: 74911 - protein, 136 aa, Homo sapiens
  Payload ID: 14802
  Gene Symbol: RNF185
  Gene Name: ring finger protein 185
  Uniprot ID: Q96GF1
  ENSP ID: ENSP00000266252
MASKGPSASASPENSSAGGPSGSSNGAGESGGQDSTFECNICLDTAKDAVISLCGHLFCWPCLHQGFQGFGFGDGGFQMSFGIGAFPFGIFATAFNINDGRPPPAVPGTPQYVDEQFLSRLFLFVALVIMFWLLIA

SEQ ID NO: 74912 - protein, 192 aa, Homo sapiens
  Payload ID: 14802
  Gene Symbol: RNF185
  Gene Name: ring finger protein 185
  Uniprot ID: Q96GF1
  ENSP ID: ENSP00000320508
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 74913 - protein, 157 aa, Homo sapiens
  Payload ID: 14802
  Gene Symbol: RNF185
  Gene Name: ring finger protein 185
  ENSP ID: ENSP00000410916
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGVRNILGEASTNELMALEVSFLALQFFSLIIKVKENL

SEQ ID NO: 74914 - protein, 192 aa, Homo sapiens; identical to SEQ ID NO: 74912
  Payload ID: 14802
  Gene Symbol: RNF185
  Gene Name: ring finger protein 185
  Uniprot ID: Q96GF1
  ENSP ID: ENSP00000427755

SEQ ID NO: 74915 - protein, 227 aa, Homo sapiens
  Payload ID: 14803
  Gene Symbol: RNF186
  Gene Name: ring finger protein 186
  Uniprot ID: Q9NXI6
  ENSP ID: ENSP00000364263
MACTKTLQQSQPISAGATTTTTAVAPAGGHSGSTECDLECLVCREPYSCPRLPKLLACQHAFCAICLKLLLCVQDNTWSITCPLCRKVTAVPGGLICSLRDHEAVVGQLAQPCTEVSLCPQGLVDPADLAAGHPSLVGEDGQDEVSANHVAARRLAAHLLLLALLIILIGPFIYPGVLRWVLTFIIALALLMSTLFCCLPSTRGSCWPSSRTLFCREQKHSHISSIA

SEQ ID NO: 74916 - protein, 235 aa, Homo sapiens
  Payload ID: 14804
  Gene Symbol: RNF187
  Gene Name: ring finger protein 187
  Uniprot ID: Q5TA31
  ENSP ID: ENSP00000306396
LALPAGPAEAACALCQRAPREPVRADCGHRFCRACVVRFWAEEDGPFPCPECADDCWQRAVEPGRPPLSRRLLALEEAAAAPARDGPASEAALQLLCRADAGPLCAACRMAAGPEPPEWEPRWRKALRGKENKGSVEIMRKDLNDARDLHGQAESAAAVWKGHVMDRRKKALTDYKKLRAFFVEEEEHFLQEAEKEEGLPEDELADPTERFRSLLQAVSELEKKHRNLGLSMLLQ

SEQ ID NO: 74917 - protein, 838 aa, Homo sapiens
  Payload ID: 14805
  Gene Symbol: RNF19A
  Gene Name: ring finger protein 19A, RBR E3 ubiquitin protein ligase
  Uniprot ID: Q9NV58
  ENSP ID: ENSP00000342667
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVDTTSVAEARHNPSIGEGSVGGLTGSLSASGSHMDRIGAIRDNLSETASTMALAGASITGSLSGSAMVNCFNRLEVQADVQKERYSLSGESGTVSLGTVSDNASTKAMAGSILNSYIPLDKEGNSMEVQVDIESKPSKFRHNSGSSSVDDGSATRSHAGGSSSGLPEGKSSATKWSKEATAGKKSKSGKLRKKGNMKINETREDMDAQLLEQQSTNSSEFEAPSLSDSMPSVADSHSSHFSEFSCSDLESMKTSCSHGSSDYHTRFATVNILPEVENDRLENSPHQCSISVVTQTASCSEVSQLNHIAEEHGNNGIKPNVDLYFGDALKETNNNHSHQTMELKVAIQTEI

SEQ ID NO: 74918 - protein, 89 aa, Homo sapiens
  Payload ID: 14805
  Gene Symbol: RNF19A
  Gene Name: ring finger protein 19A, RBR E3 ubiquitin protein ligase
  ENSP ID: ENSP00000397305
MQEQEIGFISKYNEGLCVNTDPVSILTSILDMSLHRQMGSDRDLQSSASSVSLPSVKKAPKKRRISIGSLFRRKKDNKRKSRELNGGVD

SEQ ID NO: 74919 - protein, 838 aa, Homo sapiens; identical to SEQ ID NO: 74917
  Payload ID: 14805
  Gene Symbol: RNF19A
  Gene Name: ring finger protein 19A, RBR E3 ubiquitin protein ligase
  Uniprot ID: Q9NV58
  ENSP ID: ENSP00000428968

SEQ ID NO: 74920 - protein, 58 aa, Homo sapiens
  Payload ID: 14805
  Gene Symbol: RNF19A
  Gene Name: ring finger protein 19A, RBR E3 ubiquitin protein ligase
  ENSP ID: ENSP00000429161
MSLHRQMGSDRDLQSSASSVSLPSVKKAPKKRRISIGSLFRRKKDNKRKSRELNGGVD

SEQ ID NO: 74921 - protein, 156 aa, Homo sapiens
  Payload ID: 14805
  Gene Symbol: RNF19A
  Gene Name: ring finger protein 19A, RBR E3 ubiquitin protein ligase
  ENSP ID: ENSP00000429549
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCV

SEQ ID NO: 74922 - protein, 113 aa, Homo sapiens
  Payload ID: 14805
  Gene Symbol: RNF19A
  Gene Name: ring finger protein 19A, RBR E3 ubiquitin protein ligase
  ENSP ID: ENSP00000429841
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNT

SEQ ID NO: 74923 - protein, 14 aa, Homo sapiens
  Payload ID: 14805
  Gene Symbol: RNF19A
  Gene Name: ring finger protein 19A, RBR E3 ubiquitin protein ligase
  ENSP ID: ENSP00000430553
MQEQEIGFISKYNE

SEQ ID NO: 74924 - protein, 165 aa, Homo sapiens
  Payload ID: 14805
  Gene Symbol: RNF19A
  Gene Name: ring finger protein 19A, RBR E3 ubiquitin protein ligase
  ENSP ID: ENSP00000431077
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRI

SEQ ID NO: 74925 - protein, 838 aa, Homo sapiens; identical to SEQ ID NO: 74917
  Payload ID: 14805
  Gene Symbol: RNF19A
  Gene Name: ring finger protein 19A, RBR E3 ubiquitin protein ligase
  Uniprot ID: Q9NV58
  ENSP ID: ENSP00000480369

SEQ ID NO: 74926 - protein, 731 aa, Homo sapiens
  Payload ID: 14806
  Gene Symbol: RNF19B
  Gene Name: ring finger protein 19B
  Uniprot ID: Q6ZMZ0
  ENSP ID: ENSP00000235150
MGSEKDSESPRSTSLHAAAPDPKCRSGGRRRRLTLHSVFSASARGRRARAKPQAEPPPPAAQPPPAPAPAAAQGPPPEALPAEPAAEAEAEAAAAAAEPGFDDEEAAEGGGPGAEEVECPLCLVRLPPERAPRLLSCPHRSCRDCLRHYLRLEISESRVPISCPECSERLNPHDIRLLLADPPLMHKYEEFMLRRYLASDPDCRWCPAPDCGYAVIAYGCASCPKLTCEREGCQTEFCYHCKQIWHPNQTCDMARQQRAQTLRVRTKHTSGLSYGQESGPDDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRECNNMEIQVDIEAKPSHYQLVSGSSTEDSLHVHAQMAENEEEGSGGGGSEEDPPCRHQSCEQKDCLASKPWDISLAQPESIRSDLESSDAQSDDVPDITSDECGSPRSHTAACPSTPRAQGAPSPSAHMNLSALAEGQTVLKPEGGEARV

SEQ ID NO: 74927 - protein, 587 aa, Homo sapiens
  Payload ID: 14806
  Gene Symbol: RNF19B
  Gene Name: ring finger protein 19B
  Uniprot ID: Q6ZMZ0
  ENSP ID: ENSP00000349482
MGSEKDSESPRSTSLHAAAPDPKCRSGGRRRRLTLHSVFSASARGRRARAKPQAEPPPPAAQPPPAPAPAAAQGPPPEALPAEPAAEAEAEAAAAAAEPGFDDEEAAEGGGPGAEEVECPLCLVRLPPERAPRLLSCPHRSCRDCLRHYLRLEISESRVPISCPECSERLNPHDIRLLLADPPLMHKYEEFMLRRYLASDPDCRWCPAPDCGYAVIAYGCASCPKLTCEREGCQTEFCYHCKQIWHPNQTCDMARQQRAQTLRVRTKHTSGLSYGQESGPDDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRFSMIHA

SEQ ID NO: 74928 - protein, 732 aa, Homo sapiens
  Payload ID: 14806
  Gene Symbol: RNF19B
  Gene Name: ring finger protein 19B
  Uniprot ID: Q6ZMZ0
  ENSP ID: ENSP00000362555
MGSEKDSESPRSTSLHAAAPDPKCRSGGRRRRLTLHSVFSASARGRRARAKPQAEPPPPAAQPPPAPAPAAAQGPPPEALPAEPAAEAEAEAAAAAAEPGFDDEEAAEGGGPGAEEVECPLCLVRLPPERAPRLLSCPHRSCRDCLRHYLRLEISESRVPISCPECSERLNPHDIRLLLADPPLMHKYEEFMLRRYLASDPDCRWCPAPDCGYAVIAYGCASCPKLTCEREGCQTEFCYHCKQIWHPNQTCDMARQQRAQTLRVRTKHTSGLSYGQESGPADDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRECNNMEIQVDIEAKPSHYQLVSGSSTEDSLHVHAQMAENEEEGSGGGGSEEDPPCRHQSCEQKDCLASKPWDISLAQPESIRSDLESSDAQSDDVPDITSDECGSPRSHTAACPSTPRAQGAPSPSAHMNLSALAEGQTVLKPEGGEARV

SEQ ID NO: 74929 - protein, 264 aa, Homo sapiens
  Payload ID: 14807
  Gene Symbol: RNF2
  Gene Name: ring finger protein 2
  Uniprot ID: Q99496
  ENSP ID: ENSP00000356479
MSQAVQTNGTQPLSKTWELSLYELQRTPQEAITDGLEIVVSPRSLHSELMCPICLDMLKNTMTTKECLHRFCADCIITALRSGLQRGKKQQIENGSGAEDNGDSSHCSNASTHSNQEAGPSNKRTKTSDDSGLELDNNNAAMAIDPVMDGASEIELVFRPHPTLMEKDDSAQTRYIKTSGNATVDHLSKYLAVRLALEELRSKGESNQMNLDTASEKQYTIYIATASGQFTVLNGSFSLELVSEKYWKVNKPMELYYAPTKEHK

SEQ ID NO: 74930 - protein, 336 aa, Homo sapiens
  Payload ID: 14807
  Gene Symbol: RNF2
  Gene Name: ring finger protein 2
  Uniprot ID: Q99496
  ENSP ID: ENSP00000356480
MSQAVQTNGTQPLSKTWELSLYELQRTPQEAITDGLEIVVSPRSLHSELMCPICLDMLKNTMTTKECLHRFCADCIITALRSGNKECPTCRKKLVSKRSLRPDPNFDALISKIYPSRDEYEAHQERVLARINKHNNQQALSHSIEEGLKIQAMNRLQRGKKQQIENGSGAEDNGDSSHCSNASTHSNQEAGPSNKRTKTSDDSGLELDNNNAAMAIDPVMDGASEIELVFRPHPTLMEKDDSAQTRYIKTSGNATVDHLSKYLAVRLALEELRSKGESNQMNLDTASEKQYTIYIATASGQFTVLNGSFSLELVSEKYWKVNKPMELYYAPTKEHK

SEQ ID NO: 74931 - protein, 245 aa, Homo sapiens
  Payload ID: 14807
  Gene Symbol: RNF2
  Gene Name: ring finger protein 2
  ENSP ID: ENSP00000400722
MSQAVQTNGTQPLSKTWELSLYELQRTPQEAITDGLEIVVSPRSLHSELMCPICLDMLKNTMTTKECLHRFCADCIITALRSGNKECPTCRKKLVSKRSLRPDPNFDALISKIYPSRDEYEAHQERVLARINKHNNQQALSHSIEEGLKIQAMNRLQRGKKQQIENGSGAEDNGDSSHCSNASTHSNQEAGPSNKRTKTSDDSGLELDNNNAAMAIDPVMDGASEIELVFRPHPTLMEKDDSAQT

SEQ ID NO: 74932 - protein, 181 aa, Homo sapiens
  Payload ID: 14808
  Gene Symbol: RNF20
  Gene Name: ring finger protein 20, E3 ubiquitin protein ligase
  ENSP ID: ENSP00000363952
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDDRERGEGQEPAFSFLATLASSSSEEMESQLQERVESS

SEQ ID NO: 74933 - protein, 975 aa, Homo sapiens
  Payload ID: 14808
  Gene Symbol: RNF20
  Gene Name: ring finger protein 20, E3 ubiquitin protein ligase
  Uniprot ID: Q5VTR2
  ENSP ID: ENSP00000373772
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDDRERGEGQEPAFSFLATLASSSSEEMESQLQERVESSRRAVSQIVTVYDKLQEKVELLSRKLNSGDNLIVEEAVQELNSFLAQENMRLQELTDLLQEKHRTMSQEFSKLQSKVETAESRVSVLESMIDDLQWDIDKIRKREQRLNRHLAEVLERVNSKGYKVYGAGSSLYGGTITINARKFEEMNAELEENKELAQNRLCELEKLRQDFEEVTTQNEKLKVELRSAVEQVVKETPEYRCMQSQFSVLYNESLQLKAHLDEARTLLHGTRGTHQHQVELIERDEVSLHKKLRTEVIQLEDTLAQVRKEYEMLRIEFEQTLAANEQAGPINREMRHLISSLQNHNHQLKGEVLRYKRKLREAQSDLNKTRLRSGSALLQSQSSTEDPKDEPAELKPDSEDLSSQSSASKASQEDANEIKSKRDEEERERERREKEREREREREKEKEREREKQKLKESEKERDSAKDKEKGKHDDGRKKEAEIIKQLKIELKKAQESQKEMKLLLDMYRSAPKEQRDKVQLMAAEKKSKAELEDLRQRLKDLEDKEKKENKKMADEDALRKIRAVEEQIEYLQKKLAMAKQEEEALLSEMDVTGQAFEDMQEQNIRLMQQLREKDDANFKLMSERIKSNQIHKLLKEEKEELADQVLTLKTQVDAQLQVVRKLEEKEHLLQSNIGTGEKELGLRTQALEMNKRKAMEAAQLADDLKAQLELAQKKLHDFQDEIVENSVTKEKDMFNFKRAQEDISRLRRKLETTKKPDNVPKCDEILMEEIKDYKARLTCPCCNMRKKDAVLTKCFHVFCFECVKTRYDTRQRKCPKCNAAFGANDFHRIYIG

SEQ ID NO: 74934 - protein, 145 aa, Homo sapiens
  Payload ID: 14808
  Gene Symbol: RNF20
  Gene Name: ring finger protein 20, E3 ubiquitin protein ligase
  ENSP ID: ENSP00000418924
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDD

SEQ ID NO: 74935 - protein, 99 aa, Homo sapiens
  Payload ID: 14808
  Gene Symbol: RNF20
  Gene Name: ring finger protein 20, E3 ubiquitin protein ligase
  ENSP ID: ENSP00000419201
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQ

SEQ ID NO: 74936 - protein, 634 aa, Homo sapiens
  Payload ID: 14809
  Gene Symbol: RNF207
  Gene Name: ring finger protein 207
  Uniprot ID: Q6ZRF8
  ENSP ID: ENSP00000367173
MSGAIFGPLEGPSSLDAPSIHPLVCPLCHVQYERPCLLDCFHDFCAGCLRGRATDGRLTCPLCQHQTVLKGPSGLPPVDRLLQFLVDSSGDGVEAVRCANCDLECSEQDVETTYFCNTCGQPLCARCRDETHRARMFARHDIVALGQRSRDVPQKCTLHAEPYLLFSTDKKLLLCIRCFRDMQKESRAHCVDLESAYVQGCERLEQAVLAVKALQTATREAIALLQAMVEEVRHSAAEEEDAIHALFGSMQDRLAERKALLLQAVQSQYEEKDKAFKEQLSHLATLLPTLQVHLVICSSFLSLANKAEFLDLGYELMERLQGIVTRPHHLRPIQSSKIASDHRAEFARCLEPLLLLGPRRVAAAASGANTLAGGLGPKALTGPHCPSPVGKMSGSPVQKPTLHRSISTKVLLAEGENTPFAEHCRHYEDSYRHLQAEMQSLKDQVQELHRDLTKHHSLIKAEIMGDVLHKSLQLDVQIASEHASLEGMRVVFQEIWEEAYQRVANEQEIYEAQLHDLLQLRQENAYLTTITKQITPYVRSIAKVKERLEPRFQAPVDEQSESLQNTHDDSRNNAASARNNPGSVPEKREKTSEPKGNSWAPNGLSEEPLLKNMDHHRSKQKNGGDVPTWREHPT

SEQ ID NO: 74937 - protein, 261 aa, Homo sapiens
  Payload ID: 14810
  Gene Symbol: RNF208
  Gene Name: ring finger protein 208
  Uniprot ID: Q9H0X6
  ENSP ID: ENSP00000375397
MPSDPGPEAGSGWPGLLMSCLKGPHVILKMEAMKIVHPEKFPELPAAPCFPPAPRPTPTLAPKRAWPSDTEIIVNQACGGDMPALEGAPHTPPLPRRPRKGSSELGFPRVAPEDEVIVNQYVIRPGPSASAASSAAAGEPLECPTCGHSYNVTQRRPRVLSCLHSVCEQCLQILYESCPKYKFISCPTCRRETVLFTDYGLAALAVNTSILSRLPPEALTAPSGGQWGAEPEGSCYQTFRQYCGAACTCHVRNPLSACSIM

SEQ ID NO: 74938 - protein, 261 aa, Homo sapiens; identical to SEQ ID NO: 74937
  Payload ID: 14810
  Gene Symbol: RNF208
  Gene Name: ring finger protein 208
  Uniprot ID: Q9H0X6
  ENSP ID: ENSP00000376572

SEQ ID NO: 74939 - protein, 273 aa, Homo sapiens
  Payload ID: 14811
  Gene Symbol: RNF212
  Gene Name: ring finger protein 212
  Uniprot ID: Q495C1
  ENSP ID: ENSP00000327481
MANWVFCNRCFQPPHRTSCFSLTNCGHVYCDACLGKGKKNECLICKAPCRTVLLSKHTDADIQAFFMSIDSLCKKYSRETSQYLRLSRGCCRLKLCPATSSKEVPRGSTHGSQAAARDPQEHWVSTTRAPRPGCRRSQSQPEAQGNTIQDAPHPLTLLHPSRTLIHTKSPWGQKLLEFIKHVCYHRHQSHRPCAPGWFCQVLQRPGAVSGEKTQQTRPAPPATCLLCLSCLSGFRHGPWRSQALPSDLVAPLFVSYTVEVSITNAGWSFPAAV

SEQ ID NO: 74940 - protein, 232 aa, Homo sapiens
  Payload ID: 14811
  Gene Symbol: RNF212
  Gene Name: ring finger protein 212
  Uniprot ID: Q495C1
  ENSP ID: ENSP00000372428
MANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMAPCARRVCHFQRFTMFLHRRLSSLAAPPSVQFWKARGTHQL

SEQ ID NO: 74941 - protein, 297 aa, Homo sapiens
  Payload ID: 14811
  Gene Symbol: RNF212
  Gene Name: ring finger protein 212
  Uniprot ID: Q495C1
  ENSP ID: ENSP00000389709
MANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSMRSSQQTAFSTIKSSVSTKPHGCLLPPHSSAPDRLESMEVDLSPSPIRKSEIAAGPARISMISPPQDGRMGPHLTASFCFIPWLTLSKPPVPGECVISRGSPCFCIDVCPHWLLLLAFSSGRHGELTNSKTLPIYAEVQRAVLFPFQQAEGTLDTFRTPAVSVVFPLCQFERKKSF

SEQ ID NO: 74942 - protein, 52 aa, Homo sapiens
  Payload ID: 14811
  Gene Symbol: RNF212
  Gene Name: ring finger protein 212
  ENSP ID: ENSP00000423030
MANWVFCNRCFQPPHRTSCFSLTNCGHVYCDACLGKDRRRYPGILHEHRQSV

SEQ ID NO: 74943 - protein, 115 aa, Homo sapiens
  Payload ID: 14811
  Gene Symbol: RNF212
  Gene Name: ring finger protein 212
  ENSP ID: ENSP00000423560
MANWVFCNRCFQPPHRTSCFSLTNCGHVYCDACLGKGKKNECLICKAPCRTVLLSKHRPFPVSDSESPTARLYSCVRRAPWIPHRGTRVRLRRRTLWTRLLCTRVDFLHSLRPLP

SEQ ID NO: 74944 - protein, 52 aa, Homo sapiens; identical to SEQ ID NO: 74942
  Payload ID: 14811
  Gene Symbol: RNF212
  Gene Name: ring finger protein 212
  ENSP ID: ENSP00000425843

SEQ ID NO: 74945 - protein, 123 aa, Homo sapiens
  Payload ID: 14811
  Gene Symbol: RNF212
  Gene Name: ring finger protein 212
  Uniprot ID: Q495C1
  ENSP ID: ENSP00000426115
MANWVFCNRCFQPPHRTSCFSLTNCGHVYCDACLGKGKKNECLICKAPCRTVLLSKHTDADIQAFFMSIDSLCKKYSRETSQILEFQEKHRKRLLAFYREKISRLEESLRKSVLQIEQLQSLR

SEQ ID NO: 74946 - protein, 83 aa, Homo sapiens
  Payload ID: 14812
  Gene Symbol: RNF212B
  Gene Name: ring finger protein 212B
  ENSP ID: ENSP00000382789
MQEAQQALVSQDNRSSSAESIPYREAGFGSLGQKPLHRLQLIAYLIGDFFFQTIPKWAFRPHKSPHPQQFCSEGEHNYTRESS

SEQ ID NO: 74947 - protein, 300 aa, Homo sapiens
  Payload ID: 14812
  Gene Symbol: RNF212B
  Gene Name: ring finger protein 212B
  Uniprot ID: A8MTL3
  ENSP ID: ENSP00000382794
MDWFHCNQCFRKDGAHFFVTSCGHIFCKKCVTLEKCAVCGTACKHLALSDNLKPQEKMFFKSPVETALQYFSHISQVWSFQKKQTDLLIAFYKHRITKLETAMQEAQQALVSQDKELSVLRKENGELKKFLAILKESPSRYQGSRSITPRPVGITSPSQSVTPRPSFQHSSQVVSRSSSAESIPYREAGFGSLGQGGRGLQGRRTPRDSYNETPSPASTHSLSYRTSSASSGQGIFSFRPSPNGHSGHTRVLTPNNFAQRESTTTLESLPSFQLPVLQTLYQQRRHMGLPSGREAWTTSR

SEQ ID NO: 74948 - protein, 300 aa, Homo sapiens; identical to SEQ ID NO: 74947
  Payload ID: 14812
  Gene Symbol: RNF212B
  Gene Name: ring finger protein 212B
  Uniprot ID: A8MTL3
  ENSP ID: ENSP00000397830

SEQ ID NO: 74949 - protein, 83 aa, Homo sapiens
  Payload ID: 14812
  Gene Symbol: RNF212B
  Gene Name: ring finger protein 212B
  ENSP ID: ENSP00000450766
MDWFHCNQCFRKDGAHFFVTSCGHIFCKKCVTLEKCAVCGTACKHLALSDNLKPQEKMFFKSPVETALQYFSHISQTLYQQRR

SEQ ID NO: 74950 - protein, 75 aa, Homo sapiens
  Payload ID: 14812
  Gene Symbol: RNF212B
  Gene Name: ring finger protein 212B
  ENSP ID: ENSP00000451124
VWSFQKKQTDLLIAFYKHRITKLETAMQEAQQALVSQDNRSSSAESIPYREAGFGSLGQGGRGLQGRRTPRDSYN

SEQ ID NO: 74951 - protein, 1063 aa, Homo sapiens
  Payload ID: 14813
  Gene Symbol: RNF213
  Gene Name: ring finger protein 213
  Uniprot ID: Q63HN8
  ENSP ID: ENSP00000324392
MECPSCQHVSKEETPKFCSQCGERLPPAAPIADSENNNSTMASASEGEMECGQELKEEGGPCLFPGSDSWQENPEEPCSKASWTVQESKKKKRKKKKKGNKSASSELASLPLSPASPCHLTLLSNPWPQDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLVKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQVNNLSSWETDSGSQLCSAMTQLRAMKHPLGLSSSANSEIGKWAPSSLAKGNGAEI

SEQ ID NO: 74952 - protein, 5256 aa, Homo sapiens
  Payload ID: 14813
  Gene Symbol: RNF213
  Gene Name: ring finger protein 213
  ENSP ID: ENSP00000425956
MECPSCQHVSKEETPKFCSQCGERLPPAAPIADSENNNSTMASASEGEMECGQELKEEGGPCLFPGSDSWQENPEEPCSKASWTVQEGATSEVLVDAAVDLISDEWEAANAIPSKRRKQDAAPLEAASVPSADCEQSKKKKRKKKKKGNKSASSELASLPLSPASPCHLTLLSNPWPQDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLVKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQSQTSILQGFSYSDLRKFGIVLSAVITKSWPRTADNFDDILKHLLTLADVKHVFRLCGTDEKILANVTEDAKRLIAVADSVLTKVVGDLLSGTILVGQLELIIKHKNQFLDIWQLREKSLSPQDEQCAVEEALDWRREELLLLKKEKRCVDSLLKMCGNVKHLIQVDFGVLAVRHSQDLSSKRLNDTVTVRLSTSSNSQRATHYHLSSQVQEMAGKIDLLRDSHIFQLFWREAAEPLSEPKEDQEAAELLSEPEEESERHILELEEVYDYLYQPSYRKFIKLHQDLKSGEVTLAEIDVIFKDFVNKYTDLDSELKIMCTVDHQDQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFMKHLKKLWKALDKDQYLPRKLCDSARNLEWLKTVNESHGSVERSSLTLATAINQRGIYVIQAPKGGQKISPDTVLHLILPESPGSHEESREYSLEEVKELLNKLMLMSGKKDRNNTEVERFSEVFCSVQRLSQAFIDLHSAGNMLFRTWIAMAYCSPKQGVSLQMDFGLDLVTELKEGGDVTELLAALCRQMEHFLDSWKRFVTQKRMEHFYLNFYTAEQLVYLSTELRKQPPSDAALTMLSFIKSNCTLRDVLRASVGCGSEAARYRMRRVMEELPLMLLSEFSLVDKLRIIMEQSMRCLPAFLPDCLDLETLGHCLAHLAGMGGSPVERCLPRGLQVGQPNLVVCGHSEVLPAALAVYMQTPSQPLPTYDEVLLCTPATTFEEVALLLRRCLTLGSLGHKVYSLLFADQLSYEVARQAEELFHNLCTQQHREDYQLVMVCDGDWEHCYLPSAFSQHKVFVTPQAPLEAIQAYLAGHYRVPKQTLSAAAVFNDRLCVGIVASERAGVGKSLYVKRLHDKMKMQLNVKNVPLKTIRLIDPQVDESRVLGALLPFLDAQYQKVPVLFHLDVTSSVQTGIWVFLFKLLILQYLMDINGKMWLRNPCHLYIVEILERRTSVPSRSSSALRTRVPQFSFLDIFPKVTCRPPKEVIDMELSALRSDTEPGMDLWEFCSETFQRPYQYLRRFNQNQDLDTFQYQEGSVEGTPEECLQHFLFHCGVINPSWSELRNFARFLNYQLRDCEASLFCNPSFIGDTLRGFKKFVVTFMIFMARDFATPSLHTSDQSPGKHMVTMDGVREEDLAPFSLRKRWESEPHPYVFFNDDHTTMTFIGFHLQPNINGSVDAISHLTGKVIKRDVMTRDLYQGLLLQRVPFNVDFDKLPRHKKLERLCLTLGIPQATDPDKTYELTTDNMLKILAIEMRFRCGIPVIIMGETGCGKTRLIKFLSDLRRGGTNADTIKLVKVHGGTTADMIYSRVREAENVAFANKDQHQLDTILFFDEANTTEAISCIKEVLCDHMVDGQPLAEDSGLHIIAACNPYRKHSEEMICRLESAGLGYRVSMEETADRLGSIPLRQLVYRVHALPPSLIPLVWDFGQLSDVAEKLYIQQIVQRLVESISLDENGTRVITEVLCASQGFMRKTEDECSFVSLRDVERCVKVFRWFHEHSAMLLAQLNAFLSKSSVSKNHTERDPVLWSLMLAIGVCYHASLEKKDSYRKAIARFFPKPYDDSRLLLDEITRAQDLFLDGVPLRKTIAKNLALKENVFMMVVCIELKIPLFLVGKPGSSKSLAKTIVADAMQGPAAYSDLFRSLKQVHLVSFQCSPHSTPQGIISTFRQCARFQQGKDLQQYVSVVVLDEVGLAEDSPKMPLKTLHPLLEDGCIEDDPAPHKKVGFVGISNWALDPAKMNRGIFVSRGSPNETELIESAKGICSSDILVQDRVQGYFASFAKAYETVCKRQDKEFFGLRDYYSLIKMVFAAAKASNRKPSPQDIAQAVLRNFSGKDDIQALDIFLANLPEAKCSEEVSPMQLIKQNIFGPSQKVPGGEQEDAESRYLLVLTKNYVALQILQQTFFEGDQQPEIIFGSGFPKDQEYTQLCRNINRVKICMETGKMVLLLNLQNLYESLYDALNQYYVHLGGQKYVDLGLGTHRVKCRVHPNFRLIVIEEKDVVYKHFPIPLINRLEKHYLDINTVLEKWQKSIVEELCAWVEKFINVKAHHFQKRHKYSPSDVFIGYHSDACASVVLQVIERQGPRALTEELHQKVSEEAKSILLNCATPDAVVRLSAYSLGGFAAEWLSQEYFHRQRHNSFADFLQAHLHTADLERHAIFTEITTFSRLLTSHDCEILESEVTGRAPKPTLLWLQQFDTEYSFLKEVRNCLTNTAKCKILIFQTDFEDGIRSAQLIASAKYSVINEINKIRENEDRIFVYFITKLSRVGRGTAYVGFHGGLWQSVHIDDLRRSTLMVSDVTRLQHVTISQLFAPGDLPELGLEHRAEDGHEEAMETEASTSGEVAEVAEEAMETESSEKVGKETSELGGSDVSILDTTRLLRSCVQSAVGMLRDQNESCTRNMRRVVLLLGLLNEDDACHASFLRVSKMRLSVFLKKQEESQFHPLEWLAREACNQDALQEAGTFRHTLWKRVQGAVTPLLASMISFIDRDGNLELLTRPDTPPWARDLWMFIFSDTMLLNIPLVMNNERHKGEMAYIVVQNHMNLSENASNNVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 74953 - protein, 106 aa, Homo sapiens
  Payload ID: 14813
  Gene Symbol: RNF213
  Gene Name: ring finger protein 213
  ENSP ID: ENSP00000460462
  MOD_RES (1)..(1): Any amino acid
XLSSQRGMEFVQGLSKPGRPHQWVFPKDVVKQQGLRQDHPGQMDRYLVYGDEYKALRDAVAKAVLECKPLGIKTALKVGWARGFSLIPGGIPWSLHVPWFMSNDAG

SEQ ID NO: 74954 - protein, 5207 aa, Homo sapiens
  Payload ID: 14813
  Gene Symbol: RNF213
  Gene Name: ring finger protein 213
  ENSP ID: ENSP00000464087
MECPSCQHVSKEETPKFCSQCGERLPPAAPIADSENNNSTMASASEGEMECGQELKEEGGPCLFPGSDSWQENPEEPCSKASWTVQESKKKKRKKKKKGNKSASSELASLPLSPASPCHLTLLSNPWPQDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLVKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQSQTSILQGFSYSDLRKFGIVLSAVITKSWPRTADNFDDILKHLLTLADVKHVFRLCGTDEKILANVTEDAKRLIAVADSVLTKVVGDLLSGTILVGQLELIIKHKNQFLDIWQLREKSLSPQDEQCAVEEALDWRREELLLLKKEKRCVDSLLKMCGNVKHLIQVDFGVLAVRHSQDLSSKRLNDTVTVRLSTSSNSQRATHYHLSSQVQEMAGKIDLLRDSHIFQLFWREAAEPLSEPKEDQEAAELLSEPEEESERHILELEEVYDYLYQPSYRKFIKLHQDLKSGEVTLAEIDVIFKDFVNKYTDLDSELKIMCTVDHQDQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFMKHLKKLWKALDKDQYLPRKLCDSARNLEWLKTVNESHGSVERSSLTLATAINQRGIYVIQAPKGGQKISPDTVLHLILPESPGSHEESREYSLEEVKELLNKLMLMSGKKDRNNTEVERFSEVFCSVQRLSQAFIDLHSAGNMLFRTWIAMAYCSPKQGVSLQMDFGLDLVTELKEGGDVTELLAALCRQMEHFLDSWKRFVTQKRMEHFYLNFYTAEQLVYLSTELRKQPPSDAALTMLSFIKSNCTLRDVLRASVGCGSEAARYRMRRVMEELPLMLLSEFSLVDKLRIIMEQSMRCLPAFLPDCLDLETLGHCLAHLAGMGGSPVERCLPRGLQVGQPNLVVCGHSEVLPAALAVYMQTPSQPLPTYDEVLLCTPATTFEEVALLLRRCLTLGSLGHKVYSLLFADQLSYEVARQAEELFHNLCTQQHREDYQLVMVCDGDWEHCYLPSAFSQHKVFVTPQAPLEAIQAYLAGHYRVPKQTLSAAAVFNDRLCVGIVASERAGVGKSLYVKRLHDKMKMQLNVKNVPLKTIRLIDPQVDESRVLGALLPFLDAQYQKVPVLFHLDVTSSVQTGIWVFLFKLLILQYLMDINGKMWLRNPCHLYIVEILERRTSVPSRSSSALRTRVPQFSFLDIFPKVTCRPPKEVIDMELSALRSDTEPGMDLWEFCSETFQRPYQYLRRFNQNQDLDTFQYQEGSVEGTPEECLQHFLFHCGVINPSWSELRNFARFLNYQLRDCEASLFCNPSFIGDTLRGFKKFVVTFMIFMARDFATPSLHTSDQSPGKHMVTMDGVREEDLAPFSLRKRWESEPHPYVFFNDDHTTMTFIGFHLQPNINGSVDAISHLTGKVIKRDVMTRDLYQGLLLQRVPFNVDFDKLPRHKKLERLCLTLGIPQATDPDKTYELTTDNMLKILAIEMRFRCGIPVIIMGETGCGKTRLIKFLSDLRRGGTNADTIKLVKVHGGTTADMIYSRVREAENVAFANKDQHQLDTILFFDEANTTEAISCIKEVLCDHMVDGQPLAEDSGLHIIAACNPYRKHSEEMICRLESAGLGYRVSMEETADRLGSIPLRQLVYRVHALPPSLIPLVWDFGQLSDVAEKLYIQQIVQRLVESISLDENGTRVITEVLCASQGFMRKTEDECSFVSLRDVERCVKVFRWFHEHSAMLLAQLNAFLSKSSVSKNHTERDPVLWSLMLAIGVCYHASLEKKDSYRKAIARFFPKPYDDSRLLLDEITRAQDLFLDGVPLRKTIAKNLALKENVFMMVVCIELKIPLFLVGKPGSSKSLAKTIVADAMQGPAAYSDLFRSLKQVHLVSFQCSPHSTPQGIISTFRQCARFQQGKDLQQYVSVVVLDEVGLAEDSPKMPLKTLHPLLEDGCIEDDPAPHKKVGFVGISNWALDPAKMNRGIFVSRGSPNETELIESAKGICSSDILVQDRVQGYFASFAKAYETVCKRQDKEFFGLRDYYSLIKMVFAAAKASNRKPSPQDIAQAVLRNFSGKDDIQALDIFLANLPEAKCSEEVSPMQLIKQNIFGPSQKVPGGEQEDAESRYLLVLTKNYVALQILQQTFFEGDQQPEIIFGSGFPKDQEYTQLCRNINRVKICMETGKMVLLLNLQNLYESLYDALNQYYVHLGGQKYVDLGLGTHRVKCRVHPNFRLIVIEEKDVVYKHFPIPLINRLEKHYLDINTVLEKWQKSIVEELCAWVEKFINVKAHHFQKRHKYSPSDVFIGYHSDACASVVLQVIERQGPRALTEELHQKVSEEAKSILLNCATPDAVVRLSAYSLGGFAAEWLSQEYFHRQRHNSFADFLQAHLHTADLERHAIFTEITTFSRLLTSHDCEILESEVTGRAPKPTLLWLQQFDTEYSFLKEVRNCLTNTAKCKILIFQTDFEDGIRSAQLIASAKYSVINEINKIRENEDRIFVYFITKLSRVGRGTAYVGFHGGLWQSVHIDDLRRSTLMVSDVTRLQHVTISQLFAPGDLPELGLEHRAEDGHEEAMETEASTSGEVAEVAEEAMETESSEKVGKETSELGGSDVSILDTTRLLRSCVQSAVGMLRDQNESCTRNMRRVVLLLGLLNEDDACHASFLRVSKMRLSVFLKKQEESQFHPLEWLAREACNQDALQEAGTFRHTLWKRVQGAVTPLLASMISFIDRDGNLELLTRPDTPPWARDLWMFIFSDTMLLNIPLVMNNERHKGEMAYIVVQNHMNLSENASNNVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 74955 - protein, 703 aa, Homo sapiens
  Payload ID: 14814
  Gene Symbol: RNF214
  Gene Name: ring finger protein 214
  Uniprot ID: Q8ND24
  ENSP ID: ENSP00000300650
MAASEVAGVVANAPSPPESSSLCASKSDEGLPDGLSTKDSAQKQKNSPLLSVSSQTITKENNRNVHLEHSEQNPGSSAGDTSAAHQVVLGENLIATALCLSGSGSQSDLKDVASTAGEEGDTSLRESLHPVTRSLKAGCHTKQLASRNCSEEKSPQTSILKEGNRDTSLDFRPVVSPANGVEGVRVDQDDDQDSSSLKLSQNIAVQTDFKTADSEVNTDQDIEKNLDKMMTERTLLKERYQEVLDKQRQVENQLQVQLKQLQQRREEEMKNHQEILKAIQDVTIKREETKKKIEKEKKEFLQKEQDLKAEIEKLCEKGRREVWEMELDRLKNQDGEINRNIMEETERAWKAEILSLESRKELLVLKLEEAEKEAELHLTYLKSTPPTLETVRSKQEWETRLNGVRIMKKNVRDQFNSHIQLVRNGAKLSSLPQIPTPTLPPPPSETDFMLQVFQPSPSLAPRMPFSIGQVTMPMVMPSADPRSLSFPILNPALSQPSQPSSPLPGSHGRNSPGLGSLVSPHGPHMPPAASIPPPPGLGGVKASAETPRPQPVDKLEKILEKLLTRFPQCNKAQMTNILQQIKTARTTMAGLTMEELIQLVAARLAEHERVAASTQPLGRIRALFPAPLAQISTPMFLPSAQVSYPGRSSHAPATCKLCLMCQKLVQPSELHPMACTHVLHKECIKFWAQTNTNDTCPFCPTLK

SEQ ID NO: 74956 - protein, 703 aa, Homo sapiens; identical to SEQ ID NO: 74955
  Payload ID: 14814
  Gene Symbol: RNF214
  Gene Name: ring finger protein 214
  Uniprot ID: Q8ND24
  ENSP ID: ENSP00000431643

SEQ ID NO: 74957 - protein, 513 aa, Homo sapiens
  Payload ID: 14814
  Gene Symbol: RNF214
  Gene Name: ring finger protein 214
  ENSP ID: ENSP00000432903
MAASEVAGVVANAPSPPESSSLCASKSDEGLPDGLSTKDSAQKQKNSPLLSTDFKTADSEVNTDQDIEKNLDKMMTERTLLKERYQEVLDKQRQVENQLQVQLKQLQQRREEEMKNHQEILKAIQDVTIKREETKKKIEKEKKEFLQKEQDLKAEIEKLCEKGRREVWEMELDRLKNQDGEINRNIMEETERAWKAEILSLESRKELLVLKLEEAEKEAELHLTYLKSTPPTLETVRSKQEWETRLNGVRIMKKNVRDQFNSHIQLVRNGAKLSSLPQIPTPTLPPPPSETDFMLQVFQPSPSLAPRMPFSIGQVTMPMVMPSADPRSLSFPILNPALSQPSQPSSPLPGSHGRNSPGLGSLVSPHGPHMPPAASIPPPPGLGGVKASAETPRPQPVDKLEKILEKLLTRFPQCNKAQMTNILQQIKTARTTMAGLTMEELIQLVAARLAEHERVAASTQAPATCKLCLMCQKLVQPSELHPMACTHVLHKECIKFWAQTNTNDTCPFCPTLK

SEQ ID NO: 74958 - protein, 146 aa, Homo sapiens
  Payload ID: 14814
  Gene Symbol: RNF214
  Gene Name: ring finger protein 214
  ENSP ID: ENSP00000434186
MAASEVAGVVANAPSPPESSSLCASKSDEGLPDGLSTKDSAQKQKNSPLLSVSSQTITKENNRNVHLEHSEQNPGSSAGDTSAAHQVVLGENLIATALCLSGSGSQSDLKDVASTAGEEGDTSLRESLHPVTRSLKAGCHTKQLAS

SEQ ID NO: 74959 - protein, 548 aa, Homo sapiens
  Payload ID: 14814
  Gene Symbol: RNF214
  Gene Name: ring finger protein 214
  Uniprot ID: Q8ND24
  ENSP ID: ENSP00000435361
MAASEVAGVVANAPSPPESSSLCASKSDEGLPDGLSTKDSAQKQKNSPLLSTDFKTADSEVNTDQDIEKNLDKMMTERTLLKERYQEVLDKQRQVENQLQVQLKQLQQRREEEMKNHQEILKAIQDVTIKREETKKKIEKEKKEFLQKEQDLKAEIEKLCEKGRREVWEMELDRLKNQDGEINRNIMEETERAWKAEILSLESRKELLVLKLEEAEKEAELHLTYLKSTPPTLETVRSKQEWETRLNGVRIMKKNVRDQFNSHIQLVRNGAKLSSLPQIPTPTLPPPPSETDFMLQVFQPSPSLAPRMPFSIGQVTMPMVMPSADPRSLSFPILNPALSQPSQPSSPLPGSHGRNSPGLGSLVSPHGPHMPPAASIPPPPGLGGVKASAETPRPQPVDKLEKILEKLLTRFPQCNKAQMTNILQQIKTARTTMAGLTMEELIQLVAARLAEHERVAASTQPLGRIRALFPAPLAQISTPMFLPSAQVSYPGRSSHAPATCKLCLMCQKLVQPSELHPMACTHVLHKECIKFWAQTNTNDTCPFCPTLK

SEQ ID NO: 74960 - protein, 343 aa, Homo sapiens
  Payload ID: 14815
  Gene Symbol: RNF215
  Gene Name: ring finger protein 215
  ENSP ID: ENSP00000215798
  MOD_RES (1)..(1): Any amino acid
XVRLPRQDALVLEGVRIGSEADPAPLLGGRLLLMDIVDAEQEAPVEGWIAVAYVGKEQAAQFHQENKGSGPQAYPKALVQQMRRALFLGASALLLLILNHNVVRELDISQLLLRPVIVLHYSSNVTKLLDALLQRTQATAEITSGESLSANIEWKLTLWTTCGLSKDGYGGWQDLVCLGGSRAQEQKPLQQLWNAILLVAMLLCTGLVVQAQRQASRQSQRELGGQVDLFKRRVVRRLASLKTRRCRLSRAAQGLPDPGAETCAVCLDYFCNKQWLRVLPCKHEFHRDCVDPWLMLQQTCPLCKFNVLGEHQGWGPSAYSACSSPDASLPVLLPLPCREPLLR

SEQ ID NO: 74961 - protein, 377 aa, Homo sapiens
  Payload ID: 14815
  Gene Symbol: RNF215
  Gene Name: ring finger protein 215
  Uniprot ID: Q9Y6U7
  ENSP ID: ENSP00000371800
MGPAARPALRSPPPPPPPPPSPLLLLLPLLPLWLGLAGPGAAADGSEPAAGAGRGGARAVRVDVRLPRQDALVLEGVRIGSEADPAPLLGGRLLLMDIVDAEQEAPVEGWIAVAYVGKEQAAQFHQENKGSGPQAYPKALVQQMRRALFLGASALLLLILNHNVVRELDISQLLLRPVIVLHYSSNVTKLLDALLQRTQATAEITSGESLSANIEWKLTLWTTCGLSKDGYGGWQDLVCLGGSRAQEQKPLQQLWNAILLVAMLLCTGLVVQAQRQASRQSQRELGGQVDLFKRRVVRRLASLKTRRCRLSRAAQGLPDPGAETCAVCLDYFCNKQWLRVLPCKHEFHRDCVDPWLMLQQTCPLCKFNVLGNRYSDD

SEQ ID NO: 74962 - protein, 34 aa, Homo sapiens
  Payload ID: 14815
  Gene Symbol: RNF215
  Gene Name: ring finger protein 215
  ENSP ID: ENSP00000396278
DCVDPWLMLQQTCPLCKFNVLDGGSPMARKVDGL

SEQ ID NO: 74963 - protein, 99 aa, Homo sapiens
  Payload ID: 14815
  Gene Symbol: RNF215
  Gene Name: ring finger protein 215
  ENSP ID: ENSP00000404738
MDIVDAEQEAPVEGWIAVAYVGKEQAAQFHQENKGSGPQAYPKALVQQMRRALFLGASALLLLILNHNVVRELDISQLLLRPVIVLHYSSNVTKLLDAL

SEQ ID NO: 74964 - protein, 30 aa, Homo sapiens
  Payload ID: 14815
  Gene Symbol: RNF215
  Gene Name: ring finger protein 215
  ENSP ID: ENSP00000485721
HRDCVDPWLMLQQTCPLCKFNVLGNRYSDD

SEQ ID NO: 74965 - protein, 135 aa, Homo sapiens
  Payload ID: 14815
  Gene Symbol: RNF215
  Gene Name: ring finger protein 215
  ENSP ID: ENSP00000486180
MLPSGSRSPGELLPLLVQFPAMGNSYGAMTCLTRWLRRGQKGLDDVSRAANCTSSCQLCKRICPSALGVWRGWENPGHLISNPVPRWVPSTPMPWGPGQWAAGGCVLGTSPMVWFGDPFQEPRRGTHRSRARISM

SEQ ID NO: 74966 - protein, 30 aa, Homo sapiens; identical to SEQ ID NO: 74964
  Payload ID: 14815
  Gene Symbol: RNF215
  Gene Name: ring finger protein 215
  ENSP ID: ENSP00000486757

SEQ ID NO: 74967 - protein, 58 aa, Homo sapiens
  Payload ID: 14815
  Gene Symbol: RNF215
  Gene Name: ring finger protein 215
  ENSP ID: ENSP00000487588
HRDCVDPWLMLQQTCPLCKFNVLGEHQGWGPSAYSACSSPDASLPVLLPLPCREPLLR

SEQ ID NO: 74968 - protein, 326 aa, Homo sapiens
  Payload ID: 14816
  Gene Symbol: RNF216
  Gene Name: ring finger protein 216
  ENSP ID: ENSP00000374550
MEEGNNNEEVIHLNNFHCHRGQEWINLRDGPITISDSSDEERIPMLVTPAPQQHEEEDLDDDVILTEDDSEDDYGEFLDLGPPGISEFTKPSGQTEREPKPGPSHNQAANDIVNPRSEQKVIILEEGSLLYTESDPLETQNQSSEDSETELLSNLGESAALADDQAIEEDCWLDHPYFQSLNQQPREITNQVVPQERQPEAELGRLLFQHEFPGPAFPRPEPQQGGISGPSSPQPAHPLGEFEDQQLASDDEEPGPAFPMQESQEPNLENIWGQEAAEVDQELVELLVKETRCSIFVEAMKNGSVKWGQRTRSLKTFLDLIFYVDR

SEQ ID NO: 74969 - protein, 923 aa, Homo sapiens
  Payload ID: 14816
  Gene Symbol: RNF216
  Gene Name: ring finger protein 216
  Uniprot ID: Q9NWF9
  ENSP ID: ENSP00000374552
MEEGNNNEEVIHLNNFHCHRGQEWINLRDGPITISDSSDEERIPMLVTPAPQQHEEEDLDDDVILTETNKPQRSRPNLIKPAAQWQDLKRLGEERPKKSRAAFESDKSSYFSVCNNPLFDSGAQDDSEDDYGEFLDLGPPGISEFTKPSGQTEREPKPGPSHNQAANDIVNPRSEQKVIILEEGSLLYTESDPLETQNQSSEDSETELLSNLGESAALADDQAIEEDCWLDHPYFQSLNQQPREITNQVVPQERQPEAELGRLLFQHEFPGPAFPRPEPQQGGISGPSSPQPAHPLGEFEDQQLASDDEEPGPAFPMQESQEPNLENIWGQEAAEVDQELVELLVKETEARFPDVANGFIEEIIHFKNYYDLNVLCNFLLENPDYPKREDRIIINPSSSLLASQDETKLPKIDFFDYSKLTPLDQRCFIQAADLLMADFKVLSSQDIKWALHELKGHYAITRKALSDAIKKWQELSPETSGKRKKRKQMNQYSYIDFKFEQGDIKIEKRMFFLENKRRHCRSYDRRALLPAVQQEQEFYEQKIKEMAEHEDFLLALQMNEEQYQKDGQLIECRCCYGEFPFEELTQCADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 74970 - protein, 19 aa, Homo sapiens
  Payload ID: 14816
  Gene Symbol: RNF216
  Gene Name: ring finger protein 216
  ENSP ID: ENSP00000396829
MEEGNNNEEVIHLNNFHCH

SEQ ID NO: 74971 - protein, 866 aa, Homo sapiens
  Payload ID: 14816
  Gene Symbol: RNF216
  Gene Name: ring finger protein 216
  Uniprot ID: Q9NWF9
  ENSP ID: ENSP00000404602
MEEGNNNEEVIHLNNFHCHRGQEWINLRDGPITISDSSDEERIPMLVTPAPQQHEEEDLDDDVILTEDDSEDDYGEFLDLGPPGISEFTKPSGQTEREPKPGPSHNQAANDIVNPRSEQKVIILEEGSLLYTESDPLETQNQSSEDSETELLSNLGESAALADDQAIEEDCWLDHPYFQSLNQQPREITNQVVPQERQPEAELGRLLFQHEFPGPAFPRPEPQQGGISGPSSPQPAHPLGEFEDQQLASDDEEPGPAFPMQESQEPNLENIWGQEAAEVDQELVELLVKETEARFPDVANGFIEEIIHFKNYYDLNVLCNFLLENPDYPKREDRIIINPSSSLLASQDETKLPKIDFFDYSKLTPLDQRCFIQAADLLMADFKVLSSQDIKWALHELKGHYAITRKALSDAIKKWQELSPETSGKRKKRKQMNQYSYIDFKFEQGDIKIEKRMFFLENKRRHCRSYDRRALLPAVQQEQEFYEQKIKEMAEHEDFLLALQMNEEQYQKDGQLIECRCCYGEFPFEELTQCADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 74972 - protein, 49 aa, Homo sapiens
  Payload ID: 14816
  Gene Symbol: RNF216
  Gene Name: ring finger protein 216
  ENSP ID: ENSP00000409837
MEEGNNNEEVIHLNNFHCHRGQDGILLIAQARVQWRNLDSPRAPPPGFK

SEQ ID NO: 74973 - protein, 275 aa, Homo sapiens
  Payload ID: 14817
  Gene Symbol: RNF217
  Gene Name: ring finger protein 217
  Uniprot ID: Q8TC41
  ENSP ID: ENSP00000352734
MKVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIVEEIKTYWNLISGRTRNQTQHLAPQPVLLSDMLYCLKQVFICISYLLPL

SEQ ID NO: 74974 - protein, 104 aa, Homo sapiens
  Payload ID: 14817
  Gene Symbol: RNF217
  Gene Name: ring finger protein 217
  ENSP ID: ENSP00000357399
MTCSQCNTNFCYRCGERYRQLRFFGDHTSNLSIFGCKYRYLPERPHLRRLVRGSVCAGKLFIAPLIMVLGLALGAIAVVIGLFVFPIYCLCKKQRKRSRTGMHW

SEQ ID NO: 74975 - protein, 65 aa, Homo sapiens
  Payload ID: 14817
  Gene Symbol: RNF217
  Gene Name: ring finger protein 217
  ENSP ID: ENSP00000404282
  MOD_RES (1)..(1): Any amino acid
XDSIKYKYFLELGRIDSSTKPCPQCKHFTTFKKKGHIPTPSRSESKYKQNGRMKWFQRLFGVISI

SEQ ID NO: 74976 - protein, 2 aa, Homo sapiens
  Payload ID: 14817
  Gene Symbol: RNF217
  Gene Name: ring finger protein 217
  ENSP ID: ENSP00000427711
MK

SEQ ID NO: 74977 - protein, 542 aa, Homo sapiens
  Payload ID: 14817
  Gene Symbol: RNF217
  Gene Name: ring finger protein 217
  Uniprot ID: Q8TC41
  ENSP ID: ENSP00000428698
MGEEQSTVSGGGGPQESQTLASGTAGHPEPPRPQGDSARAPPLRAASAEPSGGGCGSDWGCADTSAPEPARSLGPPGWSKSRAPAQPAGLALTGPLNPQTLPLQLELEEEEEEAGDRKEGGDEQQEAPPGEELEPRTRVGAADGLVLDVLGQRRPSLAKRQVFCSVYCVESDLPEAPASEQLSPPASPPGAPPVLNPPSTRSSFPSPRLSLPTDSLSPDGGSIELEFYLAPEPFSMPSLLGAPPYSGLGGVGDPYVPLMVLMCRVCLEDKPIKPLPCCKKAVCEECLKVYLSAQVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIGLFVFPIYCLCKKQRKRSRTGMHW

SEQ ID NO: 74978 - protein, 78 aa, Homo sapiens
  Payload ID: 14817
  Gene Symbol: RNF217
  Gene Name: ring finger protein 217
  ENSP ID: ENSP00000429012
  MOD_RES (1)..(1): Any amino acid
XVPLMVLMCRVCLEDKPIKPLPCCKKAVCEECLKVYLSAQAGVQWHDLGSRKPPHPRFKRFSCLSLPSSWDYRYNLAK

SEQ ID NO: 74979 - protein, 306 aa, Homo sapiens
  Payload ID: 14817
  Gene Symbol: RNF217
  Gene Name: ring finger protein 217
  ENSP ID: ENSP00000452812
MCRVCLEDKPIKPLPCCKKAVCEECLKVYLSAQVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIVEEIKTYWNLISGRTRNQTQHLAPQPVLLSDMLYCLKQVFICISYLLPL

SEQ ID NO: 74980 - protein, 726 aa, Homo sapiens
  Payload ID: 14818
  Gene Symbol: RNF219
  Gene Name: ring finger protein 219
  Uniprot ID: Q5W0B1
  ENSP ID: ENSP00000282003
MAQTVQNVTLSLTLPITCHICLGKVRQPVICINNHVFCSICIDLWLKNNSQCPACRVPITPENPCKEIIGGTSESEPMLSHTVRKHLRKTRLELLHKEYEDEIDCLQKEVEELKSKNLSLESQIKTILDPLTLVQGNQNEDKHLVTDNPSKINPETVAEWKKKLRTANEIYEKVKDDVDKLKEANKKLKLENGGLVRENLRLKAEVDNRSPQKFGRFAVAALQSKVEQYERETNRLKKALERSDKYIEELESQVAQLKNSSEEKEAMNSICQTALSADGKGSKGSEEDVVSKNQGDSARKQPGSSTSSSSHLAKPSSSRLCDTSSARQESTSKADLNCSKNKDLYQEQVEVMLDVTDTSMDTYLEREWGNKPSDCVPYKDEELYDLPAPCTPLSLSCLQLSTPENRESSVVQAGGSKKHSNHLRKLVFDDFCDSSNVSNKDSSEDDISRSENEKKSECFSSPKTGFWDCCSTSYAQNLDFESSEGNTIANSVGEISSKLSEKSGLCLSKRLNSIRSFEMNRTRTSSEASMDAAYLDKISELDSMMSESDNSKSPCNNGFKSLDLDGLSKSSQGSEFLEEPDKLEEKTELNLSKGSLTNDQLENGSEWKPTSFFLLSPSDQEMNEDFSLHSSSCPVTNEIKPPSCLFQTEFSQGILLSSSHRLFEDQRFGSSLFKMSSEMHSLHNHLQSPWSTSFVPEKRNKNVNQSTKRKIQSSLSSASPSKATKS

SEQ ID NO: 74981 - protein, 260 aa, Homo sapiens
  Payload ID: 14819
  Gene Symbol: RNF220
  Gene Name: ring finger protein 220
  ENSP ID: ENSP00000335580
MPRARSGRRSRGAGGREETFLRVRANRQTRLNARIGKMKRRKQDEGQVCPLCNRPLAGSEQEMSRHVEHCLSKREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICM

SEQ ID NO: 74982 - protein, 566 aa, Homo sapiens
  Payload ID: 14819
  Gene Symbol: RNF220
  Gene Name: ring finger protein 220
  Uniprot ID: Q5VTB9
  ENSP ID: ENSP00000347548
MDLHRAAFKMENSSYLPNPLASPALMVLASTAEASRDASIPCQQPRPFGVPVSVDKDVHIPFTNGSYTFASMYHRQGGVPGTFANRDFPPSLLHLHPQFAPPNLDCTPISMLNHSGVGAFRPFASTEDRESYQSAFTPAKRLKNCHDTESPHLRFSDADGKEYDFGTQLPSSSPGSLKVDDTGKKIFAVSGLISDREASSSPEDRNDRCKKKAAALFDSQAPICPICQVLLRPSELQEHMEQELEQLAQLPSSKNSLLKDAMAPGTPKSLLLSASIKREGESPTASPHSSATDDLHHSDRYQTFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 74983 - protein, 566 aa, Homo sapiens; identical to SEQ ID NO: 74982
  Payload ID: 14819
  Gene Symbol: RNF220
  Gene Name: ring finger protein 220
  Uniprot ID: Q5VTB9
  ENSP ID: ENSP00000354872

SEQ ID NO: 74984 - protein, 566 aa, Homo sapiens; identical to SEQ ID NO: 74982
  Payload ID: 14819
  Gene Symbol: RNF220
  Gene Name: ring finger protein 220
  Uniprot ID: Q5VTB9
  ENSP ID: ENSP00000361321

SEQ ID NO: 74985 - protein, 259 aa, Homo sapiens
  Payload ID: 14819
  Gene Symbol: RNF220
  Gene Name: ring finger protein 220
  ENSP ID: ENSP00000388533
MPRARSGRRSRGAGGREETFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTL

SEQ ID NO: 74986 - protein, 121 aa, Homo sapiens
  Payload ID: 14819
  Gene Symbol: RNF220
  Gene Name: ring finger protein 220
  ENSP ID: ENSP00000411541
  MOD_RES (1)..(1): Any amino acid
XEGESPTASPHSSATDDLHHSDRYQTFLRVRANRQTRLNARIGKMKRRKQDEGQVCPLCNRPLAGSEQEMSRHVEHCLSKREGSCMAEDDAVDIEHENNNRFEEYEWCGQKRIRATTLLEG

SEQ ID NO: 74987 - protein, 45 aa, Homo sapiens
  Payload ID: 14819
  Gene Symbol: RNF220
  Gene Name: ring finger protein 220
  ENSP ID: ENSP00000475383
MPRARSGRRSRGAGGREEVDLSASTSQPADPTECSDWENETEEAR

SEQ ID NO: 74988 - protein, 220 aa, Homo sapiens
  Payload ID: 14820
  Gene Symbol: RNF222
  Gene Name: ring finger protein 222
  Uniprot ID: A6NCQ9
  ENSP ID: ENSP00000343799
MSEGESKDSSGSECPVCYEKFRDLEGASRTLSCGHVFCHDCLVKYLLSTRVDGQVQRTLVCPICRYVTFLSKKSSRWPSMLDKSSQTLAVPVGLPSVPPLDSLGHTNPLAASSPAWRPPPGQARPPGSPGQSAQLPLDLLPSLPRESQIFVISRHGMPLGEQDSVLPRRSLAELSEASLAPRSARAFCCRSRALLLITLIAVVAVVAAILPWVLLVRKQA

SEQ ID NO: 74989 - protein, 220 aa, Homo sapiens; identical to SEQ ID NO: 74988
  Payload ID: 14820
  Gene Symbol: RNF222
  Gene Name: ring finger protein 222
  Uniprot ID: A6NCQ9
  ENSP ID: ENSP00000382330

SEQ ID NO: 74990 - protein, 249 aa, Homo sapiens
  Payload ID: 14821
  Gene Symbol: RNF223
  Gene Name: ring finger protein 223
  Uniprot ID: E7ERA6
  ENSP ID: ENSP00000410533
MSSGQQVWHTAVPPPRRSSSIASMPRSPSSAGSPRSPGTPGSERVASPLECSICFSGYDNIFKTPKELSCTHVFCLECLARLAAAQPVGRPGGEAVPCPFCRQPTAVPPAGAPALCTSRQLQARMPAHLRREEPVWLEGTKLCCQPLPTTPGREPGFVCVDVGLSKPAEPPAPARDPAPRRGRLARCWARCRDWRRMALVSALLLMLFCVALWPVQCALKTGNLRCLPLPPRPPATSTAASPLGPLTDN

SEQ ID NO: 74991 - protein, 156 aa, Homo sapiens
  Payload ID: 14822
  Gene Symbol: RNF224
  Gene Name: ring finger protein 224
  Uniprot ID: P0DH78
  ENSP ID: ENSP00000406665
MQDAAAGGPPGLGGGGPPEERTDCIICCSAYDLSGHLPRRLYCGHTFCQACVRRLDTPAPEQRWIPCPQCRQSTPTPRGGVAMLDLDLAAFLAVKAEREPARLEPLPLTSLKGSAITRQPAGLCPALGPQPHFPQPRYCCWGCGSLCCPPLGSPEV

SEQ ID NO: 74992 - protein, 329 aa, Homo sapiens
  Payload ID: 14823
  Gene Symbol: RNF225
  Gene Name: ring finger protein 225
  Uniprot ID: M0QZC1
  ENSP ID: ENSP00000470441
MPCPRPFWLRHSRAPQGSGPSSPGSLSAPRSPSRGEDQEEEEEEEGDGSPGSGPILPPASPVECLICVSSFDGVFKLPKRLDCGHVFCLECLARLSLATAGGGNAVACPVCRAPTRLAPRRGLPALPTQSGLLPRDARAPPSRQGSVRFDRRRGLLYLRPPPPPPGPRKARAPPPPPPLRLGRPLSRRLSLASPAWVFNAAVALAVLVAAGLVVSGVYIFFLIPHATSSGPPRPQLVALAPAPGFSWFPPRPPPGSPWAPAWTPRPTGPDLDTALPGTAEDALEPEAGPEDPAEAERTLDRRSDGTWGTEAGPGWAPWPRGARRLWGSQ

SEQ ID NO: 74993 - protein, 148 aa, Homo sapiens
  Payload ID: 14824
  Gene Symbol: RNF24
  Gene Name: ring finger protein 24
  Uniprot ID: Q9Y225
  ENSP ID: ENSP00000336753
MSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 74994 - protein, 148 aa, Homo sapiens; identical to SEQ ID NO: 74993
  Payload ID: 14824
  Gene Symbol: RNF24
  Gene Name: ring finger protein 24
  Uniprot ID: Q9Y225
  ENSP ID: ENSP00000351166

SEQ ID NO: 74995 - protein, 169 aa, Homo sapiens
  Payload ID: 14824
  Gene Symbol: RNF24
  Gene Name: ring finger protein 24
  Uniprot ID: Q9Y225
  ENSP ID: ENSP00000388550
MLNKSGESRYPALFPVLGGSSMSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 74996 - protein, 169 aa, Homo sapiens; identical to SEQ ID NO: 74995
  Payload ID: 14824
  Gene Symbol: RNF24
  Gene Name: ring finger protein 24
  Uniprot ID: Q9Y225
  ENSP ID: ENSP00000444711

SEQ ID NO: 74997 - protein, 459 aa, Homo sapiens
  Payload ID: 14825
  Gene Symbol: RNF25
  Gene Name: ring finger protein 25
  Uniprot ID: Q96BH1
  ENSP ID: ENSP00000295704
MAASASAAAGEEDWVLPSEVEVLESIYLDELQVIKGNGRTSPWEIYITLHPATAEDQDSQYVCFTLVLQVPAEYPHEVPQISIRNPRGLSDEQIHTILQVLGHVAKAGLGTAMLYELIEKGKEILTDNNIPHGQCVICLYGFQEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 74998 - protein, 158 aa, Homo sapiens
  Payload ID: 14825
  Gene Symbol: RNF25
  Gene Name: ring finger protein 25
  ENSP ID: ENSP00000403582
AASASAAAGEEDWVLPSEVEVLESIYLDELQVIKGNGRTSPWEIYITLHPATAEDQDSHIPMRCHRSLSEIPEDFQMNRSTRSYRCWATWPRLGWALPCCMNSLRKGRKFSQITTSLMASVSSASMVSRRRRPLPKHPVTTTSTATALLGTSSTWSKS

SEQ ID NO: 74999 - protein, 433 aa, Homo sapiens
  Payload ID: 14826
  Gene Symbol: RNF26
  Gene Name: ring finger protein 26
  Uniprot ID: Q9BY78
  ENSP ID: ENSP00000312439
MEAVYLVVNGLGLVLDVLTLVLDLNFLLVSSLLASLAWLLAFVYNLPHTVLTSLLHLGRGVLLSLLALIEAVVRFTCGGLQALCTLLYSCCSGLESLKLLGHLASHGALRSREILHRGVLNVVSSGHALLRQACDICAIAMSLVAYVINSLVNICLIGTQNLFSLVLALWDAVTGPLWRMTDVVAAFLAHISSSAVAMAILLWTPCQLALELLASAARLLASFVLVNLTGLVLLACVLAVTVTVLHPDFTLRLATQALSQLHARPSYHRLREDVMRLSRLALGSEAWRRVWSRSLQLASWPNRGGAPGAPQGDPMRVFSVRTRRQDTLPEAGRRSEAEEEEARTIRVTPVRGRERLNEEEPPGGQDPWKLLKEQEERKKCVICQDQSKTVLLLPCRHLCLCQACTEILMRHPVYHRNCPLCRRGILQTLNVYL

SEQ ID NO: 75000 - protein, 1072 aa, Homo sapiens
  Payload ID: 14827
  Gene Symbol: RNF31
  Gene Name: ring finger protein 31
  Uniprot ID: Q96EP0
  ENSP ID: ENSP00000315112
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 75001 - protein, 165 aa, Homo sapiens
  Payload ID: 14827
  Gene Symbol: RNF31
  Gene Name: ring finger protein 31
  ENSP ID: ENSP00000452820
  MOD_RES (1)..(1): Any amino acid
XCPKCKFSYALARGGCMHFHCTQCRHQFCSGCYNAFYAKNDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 75002 - protein, 917 aa, Homo sapiens
  Payload ID: 14827
  Gene Symbol: RNF31
  Gene Name: ring finger protein 31
  ENSP ID: ENSP00000452972
  MOD_RES (1)..(1): Any amino acid
XNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 75003 - protein, 170 aa, Homo sapiens
  Payload ID: 14827
  Gene Symbol: RNF31
  Gene Name: ring finger protein 31
  ENSP ID: ENSP00000453423
MPGEEEERAFLVAREELASALRRDSGQAFSLEQLRPLLASSLPLAARYLQLDAARLVRCNAHGEPRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPR

SEQ ID NO: 75004 - protein, 52 aa, Homo sapiens
  Payload ID: 14827
  Gene Symbol: RNF31
  Gene Name: ring finger protein 31
  ENSP ID: ENSP00000453471
MLQLSEFDPLLREIAPGPLTTPSVPGSTPGPCFLCGSAPGTLHCPSCKQALC

SEQ ID NO: 75005 - protein, 136 aa, Homo sapiens
  Payload ID: 14827
  Gene Symbol: RNF31
  Gene Name: ring finger protein 31
  ENSP ID: ENSP00000453501
MQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQN

SEQ ID NO: 75006 - protein, 921 aa, Homo sapiens
  Payload ID: 14827
  Gene Symbol: RNF31
  Gene Name: ring finger protein 31
  Uniprot ID: Q96EP0
  ENSP ID: ENSP00000453574
MDLCTRAGEPSLTQNTHPRQQALEQLLEDKVEDDMLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGLGTEGPQGTGGLEPDLARGRWACQSCTFENEAAAVLCSICERPRLAQPPSLVVDSRDAGICLQPLQQGDALLASAQSQVWYCIHCTFCNSSPGWVCVMCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 75007 - protein, 120 aa, Homo sapiens
  Payload ID: 14827
  Gene Symbol: RNF31
  Gene Name: ring finger protein 31
  ENSP ID: ENSP00000453595
MPGEEEERAFLVAREELASALRRDSGQAFSLEQLRPLLASSLPLAARYLQLDAARLVRCNAHGEPRNYLNTLPPLPGMGQTSRAWSGGFWQSTHSPAGAGQSWHCHCCRRHPGTMSWGMW

SEQ ID NO: 75008 - protein, 152 aa, Homo sapiens
  Payload ID: 14827
  Gene Symbol: RNF31
  Gene Name: ring finger protein 31
  ENSP ID: ENSP00000453601
PRNYLNTLSTALNILEKYGRNLLSPQRPRYWRGVKFNNPVFRSTVDAVQGGRDVLRLYGYTEEQPDGLSFPEGQEEPDEHQVATVTLEVLLLRTELSLLLQNTHPRQQALEQLLEDKVEDDMLQLSEFDPLLREIAPGPLTTPSVPGPVSSL

SEQ ID NO: 75009 - protein, 32 aa, Homo sapiens
  Payload ID: 14827
  Gene Symbol: RNF31
  Gene Name: ring finger protein 31
  ENSP ID: ENSP00000453645
MLQLSEFDPLLREIAPGPLTTPSVPGSTPGPC

SEQ ID NO: 75010 - protein, 143 aa, Homo sapiens
  Payload ID: 14827
  Gene Symbol: RNF31
  Gene Name: ring finger protein 31
  ENSP ID: ENSP00000453672
  MOD_RES (1)..(1): Any amino acid
XEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGHTTKSIL

SEQ ID NO: 75011 - protein, 60 aa, Homo sapiens
  Payload ID: 14827
  Gene Symbol: RNF31
  Gene Name: ring finger protein 31
  ENSP ID: ENSP00000453948
MLQLSEFDPLLREIAPGPLTTPSVPGSTPGPCFLCGSAPGTLHCPSCKQALCPACDHLFH

SEQ ID NO: 75012 - protein, 56 aa, Homo sapiens
  Payload ID: 14827
  Gene Symbol: RNF31
  Gene Name: ring finger protein 31
  ENSP ID: ENSP00000454032
MPGEEEERAFLVAREELASALRRDSGQAFSLEQLRPLLASSLPLAARYLQLDAARL

SEQ ID NO: 75013 - protein, 149 aa, Homo sapiens
  Payload ID: 14827
  Gene Symbol: RNF31
  Gene Name: ring finger protein 31
  ENSP ID: ENSP00000454048
MLQLSEFDPLLREIAPGPLTTPSVPGSTPGPCFLCGSAPGTLHCPSCKQALCPACDHLFHGHPSRAHHLRQTLPGVLQGTHLSPSLPASAQPRPQSTSLLALGDSSLSSPNPASAHLPWHCAACAMLNEPWAVLCVACDRPRGCKGLGL

SEQ ID NO: 75014 - protein, 140 aa, Homo sapiens
  Payload ID: 14827
  Gene Symbol: RNF31
  Gene Name: ring finger protein 31
  ENSP ID: ENSP00000454140
  MOD_RES (1)..(1): Any amino acid
XFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQSLQLGPGQSLEAAAE

SEQ ID NO: 75015 - protein, 310 aa, Homo sapiens
  Payload ID: 14828
  Gene Symbol: RNF32
  Gene Name: ring finger protein 32
  ENSP ID: ENSP00000308894
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKFTEISHRILCSYNTNIEELFAEIDQCLAINRSVLQQLEEKCGHEITEEEWEKIQVQNETSACFEDPCLGAHGSHFSLSNFLL

SEQ ID NO: 75016 - protein, 362 aa, Homo sapiens
  Payload ID: 14828
  Gene Symbol: RNF32
  Gene Name: ring finger protein 32
  Uniprot ID: Q9H0A6
  ENSP ID: ENSP00000315950
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKFTEISHRILCSYNTNIEELFAEIDQCLAINRSVLQQLEEKCGHEITEEEWEKIQVQALRRETHECSICLAPLSAAGGQRVGAGRRSREMALLSCSHVFHHACLLALEEFSVGDRPPFHACPLCRSCYQKKILEC

SEQ ID NO: 75017 - protein, 235 aa, Homo sapiens
  Payload ID: 14828
  Gene Symbol: RNF32
  Gene Name: ring finger protein 32
  Uniprot ID: Q9H0A6
  ENSP ID: ENSP00000376497
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKTQDWKPA

SEQ ID NO: 75018 - protein, 362 aa, Homo sapiens; identical to SEQ ID NO: 75016
  Payload ID: 14828
  Gene Symbol: RNF32
  Gene Name: ring finger protein 32
  Uniprot ID: Q9H0A6
  ENSP ID: ENSP00000376499

SEQ ID NO: 75019 - protein, 95 aa, Homo sapiens
  Payload ID: 14828
  Gene Symbol: RNF32
  Gene Name: ring finger protein 32
  Uniprot ID: Q9H0A6
  ENSP ID: ENSP00000376503
MLKNKGHSSKKDNLAVNAVALQDHILHDLQLRNLSVADHSKTQVQKKENKSLKRDTKAIIDTGLKKTTQCPKLEDSEKEYVLDPKPPPLTLGYHS

SEQ ID NO: 75020 - protein, 362 aa, Homo sapiens; identical to SEQ ID NO: 75016
  Payload ID: 14828
  Gene Symbol: RNF32
  Gene Name: ring finger protein 32
  Uniprot ID: Q9H0A6
  ENSP ID: ENSP00000385285

SEQ ID NO: 75021 - protein, 221 aa, Homo sapiens
  Payload ID: 14828
  Gene Symbol: RNF32
  Gene Name: ring finger protein 32
  ENSP ID: ENSP00000385815
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLR

SEQ ID NO: 75022 - protein, 18 aa, Homo sapiens
  Payload ID: 14828
  Gene Symbol: RNF32
  Gene Name: ring finger protein 32
  ENSP ID: ENSP00000388088
MLKNKGHSSKKDNLAVNA

SEQ ID NO: 75023 - protein, 362 aa, Homo sapiens; identical to SEQ ID NO: 75016
  Payload ID: 14828
  Gene Symbol: RNF32
  Gene Name: ring finger protein 32
  Uniprot ID: Q9H0A6
  ENSP ID: ENSP00000405588

SEQ ID NO: 75024 - protein, 372 aa, Homo sapiens
  Payload ID: 14829
  Gene Symbol: RNF34
  Gene Name: ring finger protein 34, E3 ubiquitin protein ligase
  Uniprot ID: Q969K3
  ENSP ID: ENSP00000355137
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 75025 - protein, 507 aa, Homo sapiens
  Payload ID: 14829
  Gene Symbol: RNF34
  Gene Name: ring finger protein 34, E3 ubiquitin protein ligase
  ENSP ID: ENSP00000376257
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMRMSSCKGRLRNGPESSAVTIQKDQRKVSAHSSPKRVVEQLLPWKDLQNGIALWSVVPRSKWKIKALIFVKSLPSQSPPRIYILILGLTQFLQEFFFYLPKLDTHRHLGYELLTAFLGDLLAVPQVNMTDVSTAFEEGQALISDLIAVCREEIVM

SEQ ID NO: 75026 - protein, 373 aa, Homo sapiens
  Payload ID: 14829
  Gene Symbol: RNF34
  Gene Name: ring finger protein 34, E3 ubiquitin protein ligase
  Uniprot ID: Q969K3
  ENSP ID: ENSP00000376258
MRKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 75027 - protein, 37 aa, Homo sapiens
  Payload ID: 14829
  Gene Symbol: RNF34
  Gene Name: ring finger protein 34, E3 ubiquitin protein ligase
  ENSP ID: ENSP00000451724
MWASCCGLLNEVMGTGAVRGQQSAFAGATGPFRFTPN

SEQ ID NO: 75028 - protein, 163 aa, Homo sapiens
  Payload ID: 14829
  Gene Symbol: RNF34
  Gene Name: ring finger protein 34, E3 ubiquitin protein ligase
  ENSP ID: ENSP00000452096
MWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQ

SEQ ID NO: 75029 - protein, 45 aa, Homo sapiens
  Payload ID: 14829
  Gene Symbol: RNF34
  Gene Name: ring finger protein 34, E3 ubiquitin protein ligase
  ENSP ID: ENSP00000452200
MKMASGCSCRMRKTTACVASAWMPSSTVSYWSVGTWLPAPSAASA

SEQ ID NO: 75030 - protein, 74 aa, Homo sapiens
  Payload ID: 14829
  Gene Symbol: RNF34
  Gene Name: ring finger protein 34, E3 ubiquitin protein ligase
  ENSP ID: ENSP00000452321
MWASCCGLLNEVMGTGAVRGQQSAFAGATGPFRFTPNPEFSTYPPAATEGPNIVCKACGLSFSVFRKKHVCCDC

SEQ ID NO: 75031 - protein, 180 aa, Homo sapiens
  Payload ID: 14829
  Gene Symbol: RNF34
  Gene Name: ring finger protein 34, E3 ubiquitin protein ligase
  ENSP ID: ENSP00000477987
MKGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 75032 - protein, 515 aa, Homo sapiens
  Payload ID: 14830
  Gene Symbol: RNF38
  Gene Name: ring finger protein 38
  Uniprot ID: Q9H0F5
  ENSP ID: ENSP00000259605
MACKISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 75033 - protein, 465 aa, Homo sapiens
  Payload ID: 14830
  Gene Symbol: RNF38
  Gene Name: ring finger protein 38
  Uniprot ID: Q9H0F5
  ENSP ID: ENSP00000335239
MACKSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 75034 - protein, 432 aa, Homo sapiens
  Payload ID: 14830
  Gene Symbol: RNF38
  Gene Name: ring finger protein 38
  Uniprot ID: Q9H0F5
  ENSP ID: ENSP00000343947
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 75035 - protein, 432 aa, Homo sapiens; identical to SEQ ID NO: 75034
  Payload ID: 14830
  Gene Symbol: RNF38
  Gene Name: ring finger protein 38
  Uniprot ID: Q9H0F5
  ENSP ID: ENSP00000349566

SEQ ID NO: 75036 - protein, 439 aa, Homo sapiens
  Payload ID: 14830
  Gene Symbol: RNF38
  Gene Name: ring finger protein 38
  Uniprot ID: Q9H0F5
  ENSP ID: ENSP00000367109
MQHTCTQQKKVTYKHIARFSPRNRLCQADAVFNNNLAGFQLQSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 75037 - protein, 432 aa, Homo sapiens; identical to SEQ ID NO: 75034
  Payload ID: 14830
  Gene Symbol: RNF38
  Gene Name: ring finger protein 38
  Uniprot ID: Q9H0F5
  ENSP ID: ENSP00000367117

SEQ ID NO: 75038 - protein, 439 aa, Homo sapiens; identical to SEQ ID NO: 75036
  Payload ID: 14830
  Gene Symbol: RNF38
  Gene Name: ring finger protein 38
  Uniprot ID: Q9H0F5
  ENSP ID: ENSP00000483536

SEQ ID NO: 75039 - protein, 420 aa, Homo sapiens
  Payload ID: 14831
  Gene Symbol: RNF39
  Gene Name: ring finger protein 39
  Uniprot ID: Q9H2S5
  ENSP ID: ENSP00000244360
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 75040 - protein, 354 aa, Homo sapiens
  Payload ID: 14831
  Gene Symbol: RNF39
  Gene Name: ring finger protein 39
  Uniprot ID: Q9H2S5
  ENSP ID: ENSP00000365941
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTPKSSNSEDDLPEDYPVVKKMLHRLTADLTLDPGTAHRRLLISTDRRSVQLAPPGTPAPPDGPKRFDQLPAVLGAQGFGAGRHCWEVETADAASCRDSSGEDEDDEESHYAVGAAGESVQRKGCAPGPLGERIFPLFCTCDPRAPLRIVPAES

SEQ ID NO: 75041 - protein, 354 aa, Homo sapiens
  Payload ID: 14831
  Gene Symbol: RNF39
  Gene Name: ring finger protein 39
  Uniprot ID: Q9H2S5
  ENSP ID: ENSP00000365942
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCAPGPLGERIFPLFCTCDPRAPLRIVPAES

SEQ ID NO: 75042 - protein, 420 aa, Homo sapiens
  Payload ID: 14831
  Gene Symbol: RNF39
  Gene Name: ring finger protein 39
  ENSP ID: ENSP00000373106
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTPKSSNSEDDLPEDYPVVKKMLHRLTADLTLDPGTAHRRLLISTDRRSVQLAPPGTPAPPDGPKRFDQLPAVLGAQGFGAGRHCWEVETADAASCRDSSGEDEDDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 75043 - protein, 420 aa, Homo sapiens
  Payload ID: 14831
  Gene Symbol: RNF39
  Gene Name: ring finger protein 39
  ENSP ID: ENSP00000387930
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFDQLPAVLGAQGFGAGRHCWEVETADAASCRDSSGEDADDEESHYAVGAAGESVQRKGCVRLCPAGAVWAVGGRGGRLWALTAPEPTLLGGVEPPPRRIRVDLDWERGRVAFYDGRSLDLLYAFQAPGPLGERIFPLFCTCDPRAPLRIVPAES

SEQ ID NO: 75044 - protein, 354 aa, Homo sapiens; identical to SEQ ID NO: 75041
  Payload ID: 14831
  Gene Symbol: RNF39
  Gene Name: ring finger protein 39
  Uniprot ID: Q9H2S5
  ENSP ID: ENSP00000391822

SEQ ID NO: 75045 - protein, 354 aa, Homo sapiens; identical to SEQ ID NO: 75041
  Payload ID: 14831
  Gene Symbol: RNF39
  Gene Name: ring finger protein 39
  Uniprot ID: Q9H2S5
  ENSP ID: ENSP00000392508

SEQ ID NO: 75046 - protein, 420 aa, Homo sapiens; identical to SEQ ID NO: 75039
  Payload ID: 14831
  Gene Symbol: RNF39
  Gene Name: ring finger protein 39
  Uniprot ID: Q9H2S5
  ENSP ID: ENSP00000393560

SEQ ID NO: 75047 - protein, 420 aa, Homo sapiens; identical to SEQ ID NO: 75039
  Payload ID: 14831
  Gene Symbol: RNF39
  Gene Name: ring finger protein 39
  Uniprot ID: Q9H2S5
  ENSP ID: ENSP00000395696

SEQ ID NO: 75048 - protein, 420 aa, Homo sapiens; identical to SEQ ID NO: 75039
  Payload ID: 14831
  Gene Symbol: RNF39
  Gene Name: ring finger protein 39
  Uniprot ID: Q9H2S5
  ENSP ID: ENSP00000398512

SEQ ID NO: 75049 - protein, 354 aa, Homo sapiens; identical to SEQ ID NO: 75041
  Payload ID: 14831
  Gene Symbol: RNF39
  Gene Name: ring finger protein 39
  Uniprot ID: Q9H2S5
  ENSP ID: ENSP00000401131

SEQ ID NO: 75050 - protein, 354 aa, Homo sapiens; identical to SEQ ID NO: 75041
  Payload ID: 14831
  Gene Symbol: RNF39
  Gene Name: ring finger protein 39
  Uniprot ID: Q9H2S5
  ENSP ID: ENSP00000405340

SEQ ID NO: 75051 - protein, 354 aa, Homo sapiens
  Payload ID: 14831
  Gene Symbol: RNF39
  Gene Name: ring finger protein 39
  Uniprot ID: Q9H2S5
  ENSP ID: ENSP00000407248
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCAPGPLGERIFPLFCTCDPRAPLRIVPAES

SEQ ID NO: 75052 - protein, 420 aa, Homo sapiens; identical to SEQ ID NO: 75039
  Payload ID: 14831
  Gene Symbol: RNF39
  Gene Name: ring finger protein 39
  Uniprot ID: Q9H2S5
  ENSP ID: ENSP00000407291

SEQ ID NO: 75053 - protein, 420 aa, Homo sapiens
  Payload ID: 14831
  Gene Symbol: RNF39
  Gene Name: ring finger protein 39
  Uniprot ID: Q9H2S5
  ENSP ID: ENSP00000408539
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 75054 - protein, 354 aa, Homo sapiens; identical to SEQ ID NO: 75041
  Payload ID: 14831
  Gene Symbol: RNF39
  Gene Name: ring finger protein 39
  Uniprot ID: Q9H2S5
  ENSP ID: ENSP00000415281

SEQ ID NO: 75055 - protein, 190 aa, Homo sapiens
  Payload ID: 14832
  Gene Symbol: RNF4
  Gene Name: ring finger protein 4
  Uniprot ID: P78317
  ENSP ID: ENSP00000315212
MSTRKRRGGAINSRQAQKRTREATSTPEISLEAEPIELVETAGDEIVDLTCESLEPVVVDLTHNDSVVIVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 75056 - protein, 89 aa, Homo sapiens
  Payload ID: 14832
  Gene Symbol: RNF4
  Gene Name: ring finger protein 4
  ENSP ID: ENSP00000422500
MSTRKRRGGAINSRQAQKRTREATSTPEISLEAEPIELVETAGDEIVDLTCESLEPVVVDLTHNDSVVIVDGEWFRFLFHWVWRGNWHR

SEQ ID NO: 75057 - protein, 54 aa, Homo sapiens
  Payload ID: 14832
  Gene Symbol: RNF4
  Gene Name: ring finger protein 4
  ENSP ID: ENSP00000422619
MSTRKRRGGAINSRQAQKRTREATSTPEISLEAEPIELVETAGDEIVDLTCESL

SEQ ID NO: 75058 - protein, 101 aa, Homo sapiens
  Payload ID: 14832
  Gene Symbol: RNF4
  Gene Name: ring finger protein 4
  ENSP ID: ENSP00000422728
MSTRKRRGGAINSRQAQKRTREATSTPEISLEAEPIELVETAGDEIVDLTCESLEPVVVDLTHNDSVVIVDGPQVLSVVPSAWTDTQRSCRMDVSSFPQNA

SEQ ID NO: 75059 - protein, 47 aa, Homo sapiens
  Payload ID: 14832
  Gene Symbol: RNF4
  Gene Name: ring finger protein 4
  ENSP ID: ENSP00000422938
MSTRKRRGGAINSRQAQKRTREATSTPEISLEAEPIELVETGWGAVA

SEQ ID NO: 75060 - protein, 188 aa, Homo sapiens
  Payload ID: 14832
  Gene Symbol: RNF4
  Gene Name: ring finger protein 4
  ENSP ID: ENSP00000423100
MSTRKRRGGAINSRQAQKRTREATSTPEISLEAEPIELVETAGDEIVDLTCESLEPVVVDLTHNDSVVIVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPI

SEQ ID NO: 75061 - protein, 5 aa, Homo sapiens
  Payload ID: 14832
  Gene Symbol: RNF4
  Gene Name: ring finger protein 4
  ENSP ID: ENSP00000423186
MSTRK

SEQ ID NO: 75062 - protein, 190 aa, Homo sapiens; identical to SEQ ID NO: 75055
  Payload ID: 14832
  Gene Symbol: RNF4
  Gene Name: ring finger protein 4
  Uniprot ID: P78317
  ENSP ID: ENSP00000424076

SEQ ID NO: 75063 - protein, 68 aa, Homo sapiens
  Payload ID: 14832
  Gene Symbol: RNF4
  Gene Name: ring finger protein 4
  ENSP ID: ENSP00000425667
MSTRKRRGGAINSRQAQKRTREATSTPEISLEAEPIELVETAGDEIVDLTCESLEPVVVDLTHNDSVV

SEQ ID NO: 75064 - protein, 43 aa, Homo sapiens
  Payload ID: 14832
  Gene Symbol: RNF4
  Gene Name: ring finger protein 4
  ENSP ID: ENSP00000425724
MSTRKRRGGAINSRQAQKRTREATSTPEISLEAEPIELVETDC

SEQ ID NO: 75065 - protein, 190 aa, Homo sapiens; identical to SEQ ID NO: 75055
  Payload ID: 14832
  Gene Symbol: RNF4
  Gene Name: ring finger protein 4
  Uniprot ID: P78317
  ENSP ID: ENSP00000426503

SEQ ID NO: 75066 - protein, 113 aa, Homo sapiens
  Payload ID: 14832
  Gene Symbol: RNF4
  Gene Name: ring finger protein 4
  Uniprot ID: P78317
  ENSP ID: ENSP00000426615
MSTRKRRGGAINSRQAQKRTREATSTPEISLEAEPIELVETAGDEIVDLTCESLEPVVVDLTHNDSVVIVDGPQVLSVVPSAWTDTQRSCRMDVSSFPQNAAMSSVASASVIP

SEQ ID NO: 75067 - protein, 106 aa, Homo sapiens
  Payload ID: 14832
  Gene Symbol: RNF4
  Gene Name: ring finger protein 4
  ENSP ID: ENSP00000427212
  MOD_RES (1)..(1): Any amino acid
XDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRLLLVLA

SEQ ID NO: 75068 - protein, 113 aa, Homo sapiens; identical to SEQ ID NO: 75066
  Payload ID: 14832
  Gene Symbol: RNF4
  Gene Name: ring finger protein 4
  Uniprot ID: P78317
  ENSP ID: ENSP00000446369

SEQ ID NO: 75069 - protein, 1001 aa, Homo sapiens
  Payload ID: 14833
  Gene Symbol: RNF40
  Gene Name: ring finger protein 40, E3 ubiquitin protein ligase
  Uniprot ID: O75150
  ENSP ID: ENSP00000325677
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 75070 - protein, 901 aa, Homo sapiens
  Payload ID: 14833
  Gene Symbol: RNF40
  Gene Name: ring finger protein 40, E3 ubiquitin protein ligase
  Uniprot ID: O75150
  ENSP ID: ENSP00000350563
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKSDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 75071 - protein, 961 aa, Homo sapiens
  Payload ID: 14833
  Gene Symbol: RNF40
  Gene Name: ring finger protein 40, E3 ubiquitin protein ligase
  ENSP ID: ENSP00000455180
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELREREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 75072 - protein, 111 aa, Homo sapiens
  Payload ID: 14833
  Gene Symbol: RNF40
  Gene Name: ring finger protein 40, E3 ubiquitin protein ligase
  ENSP ID: ENSP00000455678
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRC

SEQ ID NO: 75073 - protein, 174 aa, Homo sapiens
  Payload ID: 14833
  Gene Symbol: RNF40
  Gene Name: ring finger protein 40, E3 ubiquitin protein ligase
  ENSP ID: ENSP00000456538
MEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQA

SEQ ID NO: 75074 - protein, 129 aa, Homo sapiens
  Payload ID: 14833
  Gene Symbol: RNF40
  Gene Name: ring finger protein 40, E3 ubiquitin protein ligase
  ENSP ID: ENSP00000457697
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQE

SEQ ID NO: 75075 - protein, 144 aa, Homo sapiens
  Payload ID: 14833
  Gene Symbol: RNF40
  Gene Name: ring finger protein 40, E3 ubiquitin protein ligase
  ENSP ID: ENSP00000460142
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTS

SEQ ID NO: 75076 - protein, 14 aa, Homo sapiens
  Payload ID: 14833
  Gene Symbol: RNF40
  Gene Name: ring finger protein 40, E3 ubiquitin protein ligase
  ENSP ID: ENSP00000473507
AAFGAHDFHRIYIS

SEQ ID NO: 75077 - protein, 177 aa, Homo sapiens
  Payload ID: 14833
  Gene Symbol: RNF40
  Gene Name: ring finger protein 40, E3 ubiquitin protein ligase
  ENSP ID: ENSP00000477937
KLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKGYGRMRCSLQCGGLGLDSSCCQLGVWALSELFPS

SEQ ID NO: 75078 - protein, 317 aa, Homo sapiens
  Payload ID: 14834
  Gene Symbol: RNF41
  Gene Name: ring finger protein 41, E3 ubiquitin protein ligase
  Uniprot ID: Q9H4P4
  ENSP ID: ENSP00000342755
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGMISTPDAVLQAVIKRSLVESGCPASIVNELIENAHERSWPQGLATLETRQMNRRYYENYVAKRIPGKQAVVVMACENQHMGDDMVQEPGLVMIFAHGVEEI

SEQ ID NO: 75079 - protein, 246 aa, Homo sapiens
  Payload ID: 14834
  Gene Symbol: RNF41
  Gene Name: ring finger protein 41, E3 ubiquitin protein ligase
  Uniprot ID: Q9H4P4
  ENSP ID: ENSP00000377581
MRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGMISTPDAVLQAVIKRSLVESGCPASIVNELIENAHERSWPQGLATLETRQMNRRYYENYVAKRIPGKQAVVVMACENQHMGDDMVQEPGLVMIFAHGVEEI

SEQ ID NO: 75080 - protein, 190 aa, Homo sapiens
  Payload ID: 14834
  Gene Symbol: RNF41
  Gene Name: ring finger protein 41, E3 ubiquitin protein ligase
  ENSP ID: ENSP00000446595
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNL

SEQ ID NO: 75081 - protein, 317 aa, Homo sapiens; identical to SEQ ID NO: 75078
  Payload ID: 14834
  Gene Symbol: RNF41
  Gene Name: ring finger protein 41, E3 ubiquitin protein ligase
  Uniprot ID: Q9H4P4
  ENSP ID: ENSP00000447303

SEQ ID NO: 75082 - protein, 201 aa, Homo sapiens
  Payload ID: 14834
  Gene Symbol: RNF41
  Gene Name: ring finger protein 41, E3 ubiquitin protein ligase
  ENSP ID: ENSP00000448187
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILE

SEQ ID NO: 75083 - protein, 61 aa, Homo sapiens
  Payload ID: 14834
  Gene Symbol: RNF41
  Gene Name: ring finger protein 41, E3 ubiquitin protein ligase
  ENSP ID: ENSP00000448330
MGYDVTRFQGDVDEDLICPICSGVLEEPVQVISLPALPDQSQLYHPGASMRRSSRLPGTSL

SEQ ID NO: 75084 - protein, 130 aa, Homo sapiens
  Payload ID: 14834
  Gene Symbol: RNF41
  Gene Name: ring finger protein 41, E3 ubiquitin protein ligase
  ENSP ID: ENSP00000449575
MRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILE

SEQ ID NO: 75085 - protein, 146 aa, Homo sapiens
  Payload ID: 14834
  Gene Symbol: RNF41
  Gene Name: ring finger protein 41, E3 ubiquitin protein ligase
  ENSP ID: ENSP00000450164
MRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGM

SEQ ID NO: 75086 - protein, 317 aa, Homo sapiens; identical to SEQ ID NO: 75078
  Payload ID: 14834
  Gene Symbol: RNF41
  Gene Name: ring finger protein 41, E3 ubiquitin protein ligase
  Uniprot ID: Q9H4P4
  ENSP ID: ENSP00000484671

SEQ ID NO: 75087 - protein, 783 aa, Homo sapiens
  Payload ID: 14835
  Gene Symbol: RNF43
  Gene Name: ring finger protein 43
  Uniprot ID: Q68DV7
  ENSP ID: ENSP00000385328
MSGGHQLQLAALWPWLLMATLQAGFGRTGLVLAAAVESERSAEQKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 75088 - protein, 742 aa, Homo sapiens
  Payload ID: 14835
  Gene Symbol: RNF43
  Gene Name: ring finger protein 43
  ENSP ID: ENSP00000462447
MAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGEFSEGSGCGRERRLQLNISGQVKSANKGLMEAEKDTAEMTTKILNHRDSVSCWLECRNTPPLPGATPLVGRSQGGPREVLVWLRHQKGTWKAGCDGSCL

SEQ ID NO: 75089 - protein, 742 aa, Homo sapiens
  Payload ID: 14835
  Gene Symbol: RNF43
  Gene Name: ring finger protein 43
  Uniprot ID: Q68DV7
  ENSP ID: ENSP00000462502
MSGGHQLQLAALWPWLLMATLQAGFGRTGLVLAAAVESERSAEQKAIIRVIPLKMDPTGKLNLTLEGVFAGVAEITPAEGKLMQARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 75090 - protein, 783 aa, Homo sapiens; identical to SEQ ID NO: 75087
  Payload ID: 14835
  Gene Symbol: RNF43
  Gene Name: ring finger protein 43
  Uniprot ID: Q68DV7
  ENSP ID: ENSP00000462764

SEQ ID NO: 75091 - protein, 783 aa, Homo sapiens; identical to SEQ ID NO: 75087
  Payload ID: 14835
  Gene Symbol: RNF43
  Gene Name: ring finger protein 43
  Uniprot ID: Q68DV7
  ENSP ID: ENSP00000463069

SEQ ID NO: 75092 - protein, 656 aa, Homo sapiens
  Payload ID: 14835
  Gene Symbol: RNF43
  Gene Name: ring finger protein 43
  Uniprot ID: Q68DV7
  ENSP ID: ENSP00000463716
MAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 75093 - protein, 432 aa, Homo sapiens
  Payload ID: 14836
  Gene Symbol: RNF44
  Gene Name: ring finger protein 44
  Uniprot ID: Q7L0R7
  ENSP ID: ENSP00000274811
MRPWALAVTRWPPSAPVGQRRFSAGPGSTPGQLWGSPGLEGPLASPPARDERLPSQQPPSRPPHLPVEERRASAPAGGSPRMLHPATQQSPFMVDLHEQVHQGPVPLSYTVTTVTTQGFPLPTGQHIPGCSAQQLPACSVMFSGQHYPLCCLPPPLIQACTMQQLPVPYQAYPHLISSDHYILHPPPPAPPPQPTHMAPLGQFVSLQTQHPRMPLQRLDNDVDLRGDQPSLGSFTYSTSAPGPALSPSVPLHYLPHDPLHQELSFGVPYSHMMPRRLSTQRYRLQQPLPPPPPPPPPPPYYPSFLPYFLSMLPMSPTAMGPTISLDLDVDDVEMENYEALLNLAERLGDAKPRGLTKADIEQLPSYRFNPDSHQSEQTLCVVCFSDFEARQLLRVLPCNHEFHTKCVDKWLKANRTCPICRADASEVPREAE

SEQ ID NO: 75094 - protein, 45 aa, Homo sapiens
  Payload ID: 14836
  Gene Symbol: RNF44
  Gene Name: ring finger protein 44
  ENSP ID: ENSP00000424699
MRPWALAVTRWPPSAPVGQRRFSAGPGSTPGQLWGSRRPDLHTSP

SEQ ID NO: 75095 - protein, 226 aa, Homo sapiens
  Payload ID: 14836
  Gene Symbol: RNF44
  Gene Name: ring finger protein 44
  ENSP ID: ENSP00000425253
  MOD_RES (1)..(1): Any amino acid
XPSVPLHYLPHDPLHQELSFGVPYSHMMPRRLSTQRYRLQQPLPPPPPPPPPPPYYPSFLPYFLSMLPMSPTAMGPTISLDLDVDDVEMENYEALLNLAERLGDAKPRGLTKADIEQLPSYRFNPDSHQSEQTLCVVCFSDFEARQLLRVLPCNHEFHTKCVDKWLKVTLPRSAPGYSSCSDGGMGWPGLFPSLSLSSSRKFWLQRTKSPQVAAQMWWVGAGESNA

SEQ ID NO: 75096 - protein, 46 aa, Homo sapiens
  Payload ID: 14836
  Gene Symbol: RNF44
  Gene Name: ring finger protein 44
  ENSP ID: ENSP00000427604
MRPWALAVTRWPPSAPVGQRRFSAGPGSTPGQLWGSSRRPDLHTSP

SEQ ID NO: 75097 - protein, 180 aa, Homo sapiens
  Payload ID: 14837
  Gene Symbol: RNF5
  Gene Name: ring finger protein 5, E3 ubiquitin protein ligase
  Uniprot ID: Q99942
  ENSP ID: ENSP00000364235
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASSWQDSLFLFLAIFFFFWLLSI

SEQ ID NO: 75098 - protein, 180 aa, Homo sapiens; identical to SEQ ID NO: 75097
  Payload ID: 14837
  Gene Symbol: RNF5
  Gene Name: ring finger protein 5, E3 ubiquitin protein ligase
  Uniprot ID: Q99942
  ENSP ID: ENSP00000387879

SEQ ID NO: 75099 - protein, 180 aa, Homo sapiens; identical to SEQ ID NO: 75097
  Payload ID: 14837
  Gene Symbol: RNF5
  Gene Name: ring finger protein 5, E3 ubiquitin protein ligase
  Uniprot ID: Q99942
  ENSP ID: ENSP00000388795

SEQ ID NO: 75100 - protein, 180 aa, Homo sapiens; identical to SEQ ID NO: 75097
  Payload ID: 14837
  Gene Symbol: RNF5
  Gene Name: ring finger protein 5, E3 ubiquitin protein ligase
  Uniprot ID: Q99942
  ENSP ID: ENSP00000401172

SEQ ID NO: 75101 - protein, 180 aa, Homo sapiens; identical to SEQ ID NO: 75097
  Payload ID: 14837
  Gene Symbol: RNF5
  Gene Name: ring finger protein 5, E3 ubiquitin protein ligase
  Uniprot ID: Q99942
  ENSP ID: ENSP00000413131

SEQ ID NO: 75102 - protein, 180 aa, Homo sapiens; identical to SEQ ID NO: 75097
  Payload ID: 14837
  Gene Symbol: RNF5
  Gene Name: ring finger protein 5, E3 ubiquitin protein ligase
  Uniprot ID: Q99942
  ENSP ID: ENSP00000415127

SEQ ID NO: 75103 - protein, 180 aa, Homo sapiens; identical to SEQ ID NO: 75097
  Payload ID: 14837
  Gene Symbol: RNF5
  Gene Name: ring finger protein 5, E3 ubiquitin protein ligase
  Uniprot ID: Q99942
  ENSP ID: ENSP00000415784

SEQ ID NO: 75104 - protein, 91 aa, Homo sapiens
  Payload ID: 14837
  Gene Symbol: RNF5
  Gene Name: ring finger protein 5, E3 ubiquitin protein ligase
  ENSP ID: ENSP00000434880
MAAAEEEDGGPEGPNRERGGAGATFECNICLETAREAVVSVCGHLYCWPCLHQWLETRPERQECPVCKAGISREKVVPLYGRGSQKPQDPR

SEQ ID NO: 75105 - protein, 113 aa, Homo sapiens
  Payload ID: 14838
  Gene Symbol: RNF7
  Gene Name: ring finger protein 7
  Uniprot ID: Q9UBF6
  ENSP ID: ENSP00000273480
MADVEDGEETCALASHSGSSGSKSGGDKMFSLKKWNAVAMWSWDVECDTCAICRVQVMDACLRCQAENKQEDCVVVWGECNHSFHNCCMSLWVKQNNRCPLCQQDWVVQRIGK

SEQ ID NO: 75106 - protein, 90 aa, Homo sapiens
  Payload ID: 14838
  Gene Symbol: RNF7
  Gene Name: ring finger protein 7
  Uniprot ID: Q9UBF6
  ENSP ID: ENSP00000376725
MADVEDGEETCALASHSGSSGSKSGGDKMFSLKKWNAVAMWSWDVECDTCAICRVQMPVLDVKLKTNKRTVLWSGENVIIPSTTAACPCG

SEQ ID NO: 75107 - protein, 97 aa, Homo sapiens
  Payload ID: 14838
  Gene Symbol: RNF7
  Gene Name: ring finger protein 7
  Uniprot ID: Q9UBF6
  ENSP ID: ENSP00000419084
MADVEDGEETCALASHSGSSGSKSGGDKMFSLKKWNAVAMWSWDVECDTCAICRVQVMVVWGECNHSFHNCCMSLWVKQNNRCPLCQQDWVVQRIGK

SEQ ID NO: 75108 - protein, 108 aa, Homo sapiens
  Payload ID: 14838
  Gene Symbol: RNF7
  Gene Name: ring finger protein 7
  Uniprot ID: Q9UBF6
  ENSP ID: ENSP00000419339
MADVEDGEETCALASHSGSSGSKSGGDKMFSLKKWNAVAMWSWDVECDTCAICRVQVMDEGIGVRNWSEALNLINASEMGFDCRSGSTALAVPSVSLASHQPCLDDHR

SEQ ID NO: 75109 - protein, 68 aa, Homo sapiens
  Payload ID: 14838
  Gene Symbol: RNF7
  Gene Name: ring finger protein 7
  ENSP ID: ENSP00000419979
MADVEDGEETCALASHSGSSGSKSGGDKMFSLKKWNAVAMWSWDVECDTCAICRVQMRELEFVIGPRP

SEQ ID NO: 75110 - protein, 98 aa, Homo sapiens
  Payload ID: 14839
  Gene Symbol: RNF8
  Gene Name: ring finger protein 8, E3 ubiquitin protein ligase
  Uniprot ID: O76064
  ENSP ID: ENSP00000229866
MGEPGFFVTGDRAGGRSWCLRRVGMSAGWLLLEDGCEVTVGRGFGVTYQLVSKICPLMISRNHCVLKQNPEGQWTIMDNKSFPSEKAEDFTAAGERFL

SEQ ID NO: 75111 - protein, 485 aa, Homo sapiens
  Payload ID: 14839
  Gene Symbol: RNF8
  Gene Name: ring finger protein 8, E3 ubiquitin protein ligase
  Uniprot ID: O76064
  ENSP ID: ENSP00000362578
MGEPGFFVTGDRAGGRSWCLRRVGMSAGWLLLEDGCEVTVGRGFGVTYQLVSKICPLMISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEHWALMEELNRSKKDFEAIIQAKNKELEQTKEEKEKMQAQKEEVLSHMNDVLENELQCIICSEYFIEAVTLNCAHSFCSYCINEWMKRKIECPICRKDIKSKTYSLVLDNCINKMVNNLSSEVKERRIVLIRERKAKRLF

SEQ ID NO: 75112 - protein, 208 aa, Homo sapiens
  Payload ID: 14839
  Gene Symbol: RNF8
  Gene Name: ring finger protein 8, E3 ubiquitin protein ligase
  ENSP ID: ENSP00000417599
  MOD_RES (1)..(1): Any amino acid
XPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEEEKEKMQAQKEEVLSHMNDVLENELQCIICSEYFIEQRDCSEDRALRAFERLPGSASLRWSGGFSLAVTPLL

SEQ ID NO: 75113 - protein, 205 aa, Homo sapiens
  Payload ID: 14839
  Gene Symbol: RNF8
  Gene Name: ring finger protein 8, E3 ubiquitin protein ligase
  ENSP ID: ENSP00000417736
MISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQ

SEQ ID NO: 75114 - protein, 448 aa, Homo sapiens
  Payload ID: 14839
  Gene Symbol: RNF8
  Gene Name: ring finger protein 8, E3 ubiquitin protein ligase
  Uniprot ID: O76064
  ENSP ID: ENSP00000418879
MGEPGFFVTGDRAGGRSWCLRRVGMSAGWLLLEDGCEVTVGRGFGVTYQLVSKICPLMISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEHWALMEELNRSKKDFEAIIQAKNKELEQTKEEKEKMQAQKEEVLSHMNDVLENELQCIICSEYFIEQRDCSEDRALRAFERLPGSASLRWSGGFSLAVTPLL

SEQ ID NO: 75115 - protein, 89 aa, Homo sapiens
  Payload ID: 14839
  Gene Symbol: RNF8
  Gene Name: ring finger protein 8, E3 ubiquitin protein ligase
  ENSP ID: ENSP00000419859
MGEPGFFVTGDRAGGRSWCLRRVGMSAGWLLLEDGCEVTVGRGFGVTYQLVSKICPLMISRNHCVLKQNPEGQWTIMDNKGTTSLSKER

SEQ ID NO: 75116 - protein, 49 aa, Homo sapiens
  Payload ID: 14839
  Gene Symbol: RNF8
  Gene Name: ring finger protein 8, E3 ubiquitin protein ligase
  ENSP ID: ENSP00000420268
MGEPGFFVTGDRAGGRSWCLRRVGMSAGWLLLEDGCEGCYELDWSNRKV

SEQ ID NO: 75117 - protein, 624 aa, Homo sapiens
  Payload ID: 14840
  Gene Symbol: RLIM
  Gene Name: ring finger protein, LIM domain interacting
  Uniprot ID: Q9NVW2
  ENSP ID: ENSP00000253571
MENSDSNDKGSGDQSAAQRRSQMDRLDREEAFYQFVNNLSEEDYRLMRDNNLLGTPGESTEEELLRRLQQIKEGPPPQNSDENRGGDSSDDVSNGDSIIDWLNSVRQTGNTTRSGQRGNQSWRAVSRTNPNSGDFRFSLEINVNRNNGSQNSENENEPSARRSSGENVENNSQRQVENPRSESTSARPSRSERNSTEALTEVPPTRGQRRARSRSPDHRRTRARAERSRSPLHPMSEIPRRSHHSISSQTFEHPLVNETEGSSRTRHHVTLRQQISGPELLSRGLFAASGTRNASQGAGSSDTAASGESTGSGQRPPTIVLDLQVRRVRPGEYRQRDSIASRTRSRSQTPNNTVTYESERGGFRRTFSRSERAGVRTYVSTIRIPIRRILNTGLSETTSVAIQTMLRQIMTGFGELSYFMYSDSDSEPTGSVSNRNMERAESRSGRGGSGGGSSSGSSSSSSSSSSSSSSSSSSSSPSSSSGGESSETSSDLFEGSNEGSSSSGSSGARREGRHRAPVTFDESGSLPFLSLAQFFLLNEDDDDQPRGLTKEQIDNLAMRSFGENDALKTCSVCITEYTEGNKLRKLPCSHEYHVHCIDRWLSENSTCPICRRAVLASGNRESVV

SEQ ID NO: 75118 - protein, 624 aa, Homo sapiens; identical to SEQ ID NO: 75117
  Payload ID: 14840
  Gene Symbol: RLIM
  Gene Name: ring finger protein, LIM domain interacting
  Uniprot ID: Q9NVW2
  ENSP ID: ENSP00000328059

SEQ ID NO: 75119 - protein, 435 aa, Homo sapiens
  Payload ID: 14841
  Gene Symbol: RNFT1
  Gene Name: ring finger protein, transmembrane 1
  Uniprot ID: Q5M7Z0
  ENSP ID: ENSP00000304670
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRERSSKIQCAWLLVFLAGSSVLLYYTFHSQSLYYSLIFLNPTLDHLSFWEVFWIVGITDFILKFFFMGLKCLILLVPSFIMPFKSKGYWYMLLEELCQYYRTFVPIPVWFRYLISYGEFGNVTRWSLGILLALLYLILKLLEFFGHLRTFRQVLRIFFTQPSYGVAASKRQCSDVDDICSICQAEFQKPILLICQHIFCEECMTLWFNREKTCPLCRTVISDHINKWKDGATSSHLQIY

SEQ ID NO: 75120 - protein, 198 aa, Homo sapiens
  Payload ID: 14841
  Gene Symbol: RNFT1
  Gene Name: ring finger protein, transmembrane 1
  ENSP ID: ENSP00000389049
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKAAKKSSIYFDSERQTCMQHITGISLGIGLLTTFMYANKSIVNQVFLRVS

SEQ ID NO: 75121 - protein, 245 aa, Homo sapiens
  Payload ID: 14841
  Gene Symbol: RNFT1
  Gene Name: ring finger protein, transmembrane 1
  Uniprot ID: Q5M7Z0
  ENSP ID: ENSP00000436144
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRLNFFKSYFGPFELLGSILDCWNYRLHSEILFHGLKMPYFIGAFFHHAF

SEQ ID NO: 75122 - protein, 172 aa, Homo sapiens
  Payload ID: 14841
  Gene Symbol: RNFT1
  Gene Name: ring finger protein, transmembrane 1
  ENSP ID: ENSP00000436533
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITA

SEQ ID NO: 75123 - protein, 71 aa, Homo sapiens
  Payload ID: 14841
  Gene Symbol: RNFT1
  Gene Name: ring finger protein, transmembrane 1
  ENSP ID: ENSP00000436909
  MOD_RES (1)..(1): Any amino acid
XAANNFYVCKQKHCKSGFSKRKVLKDSVCLVTGILSRIFCSFILHLSFSVTLLQARKVSTMTNREDFFLIL

SEQ ID NO: 75124 - protein, 223 aa, Homo sapiens
  Payload ID: 14841
  Gene Symbol: RNFT1
  Gene Name: ring finger protein, transmembrane 1
  ENSP ID: ENSP00000464987
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGISLGIGLLTTFMYANKSIVNQVFLRERSSKIQCAWLLVFLAGSSVLLYYTFHSQSLYYSLIFLNPTLDHLSFWEVFWIVGITDFIL

SEQ ID NO: 75125 - protein, 444 aa, Homo sapiens
  Payload ID: 14842
  Gene Symbol: RNFT2
  Gene Name: ring finger protein, transmembrane 2
  Uniprot ID: Q96EX2
  ENSP ID: ENSP00000257575
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQHVFCEECLCLWLDRERTCPLCRSVAVDTLRCWKDGATSAHFQVY

SEQ ID NO: 75126 - protein, 321 aa, Homo sapiens [sequence omitted]

SEQ ID NO: 75127 - protein, 444 aa, Homo sapiens; identical to SEQ ID NO: 75125
  Payload ID: 14842
  Gene Symbol: RNFT2
  Gene Name: ring finger protein, transmembrane 2
  Uniprot ID: Q96EX2
  ENSP ID: ENSP00000376332

SEQ ID NO: 75128 - protein, 420 aa, Homo sapiens
  Payload ID: 14842
  Gene Symbol: RNFT2
  Gene Name: ring finger protein, transmembrane 2
  Uniprot ID: Q96EX2
  ENSP ID: ENSP00000385669
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQMLLKGHKKLELEKIDESAGV

SEQ ID NO: 75129 - protein, 41 aa, Homo sapiens
  Payload ID: 14842
  Gene Symbol: RNFT2
  Gene Name: ring finger protein, transmembrane 2
  ENSP ID: ENSP00000447294
MWLFTVNQVLRKMQRRHSSNTDNIPPESCDQGWPLWGTGGH

SEQ ID NO: 75130 - protein, 231 aa, Homo sapiens [sequence omitted]

SEQ ID NO: 75131 - protein, 317 aa, Homo sapiens
  Payload ID: 14843
  Gene Symbol: RYBP
  Gene Name: RING1 and YY1 binding protein
  Uniprot ID: Q8N488
  ENSP ID: ENSP00000419494
  MOD_RES (1)..(1): Any amino acid
XLPAPAAALPGAPPPPPGVRGYPARARGLQGASGGARFPSSLSLPVPGKGGWVVSRAKFPALDSCEITTAHPRLCFAVSPPFSCSLPLPSLFPHSPLLGRPKRQAKPAADEGFWDCSVCTFRNSAEAFKCSICDVRKGTSTRKPRINSQLVAQQVAQQYATPPPPKKEKKEKVEKQDKEKPEKDKEISPSVTKKNTNKKTKPKSDILKDPPSEANSIQSANATTKTSETNHTSRPRLKNVDRSTAQQLAVTVGNVTVIITDFKEKTRSSSTSSSTVTSSAGSEQQNQSSSGSESTDKGSSRSSTPKGDMSAVNDESF

SEQ ID NO: 75132 - protein, 226 aa, Homo sapiens
  Payload ID: 14843
  Gene Symbol: RYBP
  Gene Name: RING1 and YY1 binding protein
  ENSP ID: ENSP00000486012
MGDKKSPTRPKRQAKPAADEGFWDCSVCTFRNSAEAFKCSICDVRKGTSTRKPRINSQLVAQQVAQQYATPPPPKKEKKEKVEKQDKEKPEKDKEISPSVTKKNTNKKTKPKSDILKDPPSEANSIQSANATTKTSETNHTSRPRLKNVDRSTAQQLAVTVGNVTVIITDFKEKTRSSSTSSSTVTSSAGSEQQNQSSSGSESTDKGSSRSSTPKGDMSAVNDESF

SEQ ID NO: 75133 - protein, 108 aa, Homo sapiens [sequence omitted]

SEQ ID NO: 75134 - protein, 568 aa, Homo sapiens
  Payload ID: 14845
  Gene Symbol: RIOK1
  Gene Name: RIO kinase 1
  Uniprot ID: Q9BRS2
  ENSP ID: ENSP00000369162
MDYRRLLMSRVVPGQFDDADSSDSENRDLKTVKEKDDILFEDLQDNVNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVYHASTANGESRAIKIYKTSILVFKDRDKYVSGEFRFRHGYCKGNPRKMVKTWAEKEMRNLIRLNTAEIPCPEPIMLRSHVLVMSFIGKDDMPAPLLKNVQLSESKARELYLQVIQYMRRMYQDARLVHADLSEFNMLYHGGGVYIIDVSQSVEHDHPHALEFLRKDCANVNDFFMRHSVAVMTVRELFEFVTDPSITHENMDAYLSKAMEIASQRTKEERSSQDHVDEEVFKRAYIPRTLNEVKNYERDMDIIMKLKEEDMAMNAQQDNILYQTVTGLKKDLSGVQKVPALLENQVEERTCSDSEDIGSSECSDTDSEEQGDHARPKKHTTDPDIDKKERKKMVKEAQREKRKNKIPKHVKKRKEKTAKTKKGK

SEQ ID NO: 75135 - protein, 95 aa, Homo sapiens
  Payload ID: 14845
  Gene Symbol: RIOK1
  Gene Name: RIO kinase 1
  ENSP ID: ENSP00000418263
MDYRRLLMSRVVPGQFDDADSSDSENRDLKTVKEKDDILFEDLQDNVNENGEGEIEDEEEEGYDDDDDDWDWDEGVGKLAKGYVWNGGSNPQLVP

SEQ ID NO: 75136 - protein, 552 aa, Homo sapiens
  Payload ID: 14846
  Gene Symbol: RIOK2
  Gene Name: RIO kinase 2
  Uniprot ID: Q9BVS4
  ENSP ID: ENSP00000283109
MGKVNVAKLRYMSRDDFRVLTAVEMGMKNHEIVPGSLIASIASLKHGGCNKVLRELVKHKLIAWERTKTVQGYRLTNAGYDYLALKTLSSRQVVESVGNQMGVGKESDIYIVANEEGQQFALKLHRLGRTSFRNLKNKRDYHKHRHNVSWLYLSRLSAMKEFAYMKALYERKFPVPKPIDYNRHAVVMELINGYPLCQIHHVEDPASVYDEAMELIVKLANHGLIHGDFNEFNLILDESDHITMIDFPQMVSTSHPNAEWYFDRDVKCIKDFFMKRFSYESELFPTFKDIRREDTLDVEVSASGYTKEMQADDELLHPLGPDDKNIETKEGSEFSFSDGEVAEKAEVYGSENESERNCLEESEGCYCRSSGDPEQIKEDSLSEESADARSFEMTEFNQALEEIKGQVVENNSVTEFSEEKNRTENYNRQDGQRVQGGVPAGSDEYEDECPHLIALSSLNREFRPFRDEENVGAMNQYRTRTLSITSSGSAVSCSTIPPELVKQKVKRQLTKQQKSAVRRRLQKGEANIFTKQRRENMQNIKSSLEAASFWGE

SEQ ID NO: 75137 - protein, 474 aa, Homo sapiens
  Payload ID: 14846
  Gene Symbol: RIOK2
  Gene Name: RIO kinase 2
  Uniprot ID: Q9BVS4
  ENSP ID: ENSP00000420932
MGKVNVAKLRYMSRDDFRVLTAVEMGMKNHEIVPGSLIASIASLKHGGCNKVLRELVKHKLIAWERTKTVQGYRLTNAGYDYLALKTLSSRQVVESVGNQMGVGKESDIYIVANEEGQQFALKLHRLGRTSFRNLKNKRDYHKHRHNVSWLYLSRLSAMKEFAYMKALYERKFPVPKPIDYNRHAVVMELINGYPLCQIHHVEDPASVYDEAMELIVKLANHGLIHGDFNEFNLILDESDHITMIDFPQMVSTSHPNAEWYFDRDVKCIKDFFMKRFSYESELFPTFKDIRREDTLDVEVSASGYTKEMQADDELLHPLGPDDKNIETKEGSEFSFSDGEVAEKAEVYGSENESERNCLEESEGCYCRSSGDPEQIKEDSLSEESADARSFEMTEFNQALEEIKGQVVENNSVTEFSEEKNRTENYNRQDGQRVQGGVPAGSDEYEDECPHLIALSSLNREFRPFRYRLLSIAF

SEQ ID NO: 75138 - protein, 159 aa, Homo sapiens
  Payload ID: 14846
  Gene Symbol: RIOK2
  Gene Name: RIO kinase 2
  ENSP ID: ENSP00000421830
  MOD_RES (1)..(1): Any amino acid
XDGQRVQGGVPAGSDEYEDECPHLIALSSLNREFRPFSCVSVSQGYCHLNNKLGKLNQKLKRKRGVTEAQDFEDEENVGAMNQYRTRTLSITSSGSAVSCSTIPPELVKQKVKRQLTKQQKSAVRRRLQKGEANIFTKQRRENMQNIKSSLEAASFWGE

SEQ ID NO: 75139 - protein, 140 aa, Homo sapiens
  Payload ID: 14846
  Gene Symbol: RIOK2
  Gene Name: RIO kinase 2
  ENSP ID: ENSP00000422772
  MOD_RES (1)..(1): Any amino acid
XEESADARSFEMTEFNQALEEIKGQVVENNSVTEFSEEKNRTENYNRQDGQRVQGGVPAGSDEYEDECPHLIALSSLNREFRPFRDEENVGAMNQYRTRTLSITSSGSAVSCSTIPPVSSHSTCTECLLHHYCDLIALSH

SEQ ID NO: 75140 - protein, 37 aa, Homo sapiens
  Payload ID: 14846
  Gene Symbol: RIOK2
  Gene Name: RIO kinase 2
  ENSP ID: ENSP00000424325
MGKVNVAKLRYMSRDDFRVLTAVRNPPFLFSLPLNTV

SEQ ID NO: 75141 - protein, 519 aa, Homo sapiens
  Payload ID: 14847
  Gene Symbol: RIOK3
  Gene Name: RIO kinase 3
  Uniprot ID: O14730
  ENSP ID: ENSP00000341874
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 75142 - protein, 516 aa, Homo sapiens
  Payload ID: 14847
  Gene Symbol: RIOK3
  Gene Name: RIO kinase 3
  Uniprot ID: O14730
  ENSP ID: ENSP00000462548
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQKGGVKEALSERELFNAVSGLNITADNEADFLAEIEALEKMNEDHVQKNGRKAASFLKDDGDPPLLYDE

SEQ ID NO: 75143 - protein, 89 aa, Homo sapiens
  Payload ID: 14847
  Gene Symbol: RIOK3
  Gene Name: RIO kinase 3
  ENSP ID: ENSP00000463644
IDVSQSVEPTHPHGLEFLFRDCRNVSQFFQKGGVKEALSERELFNAVSGLNITADNEADFLAEVTATPCKDDGDARISANSCLSMGLSC

SEQ ID NO: 75144 - protein, 503 aa, Homo sapiens
  Payload ID: 14847
  Gene Symbol: RIOK3
  Gene Name: RIO kinase 3
  ENSP ID: ENSP00000463660
MDLVGVASPEPGTAAAWGPSKCPWAIPQNTISCSLADVMSEQLAKELQLEEEAAVFPEVADLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 75145 - protein, 135 aa, Homo sapiens
  Payload ID: 14847
  Gene Symbol: RIOK3
  Gene Name: RIO kinase 3
  ENSP ID: ENSP00000463791
  MOD_RES (1)..(1): Any amino acid
XAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKNAESWNSLSNSCTTEETHFSYVFYWP

SEQ ID NO: 75146 - protein, 151 aa, Homo sapiens
  Payload ID: 14848
  Gene Symbol: RIPPLY1
  Gene Name: ripply transcriptional repressor 1
  Uniprot ID: Q0D2K3
  ENSP ID: ENSP00000276173
MDSAACAAAATPVPALALALAPDLAQAPLALPGLLSPSCLLSSGQEVNGSERGTCLWRPWLSSTNDSPRQMRKLVDLAAGGATAAEVTKAESKFHHPVRLFWPKSRSFDYLYSAGEILLQNFPVQATINLYEDSDSEEEEEDEEQEDEEEK

SEQ ID NO: 75147 - protein, 104 aa, Homo sapiens
  Payload ID: 14848
  Gene Symbol: RIPPLY1
  Gene Name: ripply transcriptional repressor 1
  Uniprot ID: Q0D2K3
  ENSP ID: ENSP00000400539
MDSAACAAAATPVPALALALAPDLAQAPLALPGLLSPSCLLSSGQEVNGSERLFWPKSRSFDYLYSAGEILLQNFPVQATINLYEDSDSEEEEEDEEQEDEEEK

SEQ ID NO: 75148 - protein, 70 aa, Homo sapiens
  Payload ID: 14849
  Gene Symbol: RIPPLY2
  Gene Name: ripply transcriptional repressor 2
  Uniprot ID: Q5TAB7
  ENSP ID: ENSP00000358701
MPDGPGMTAASGKLYQFRHPVRLFWPKSKCYDYLYQEAEALLKNFPIQATISFYEDSDSEDEIEDLTCEN

SEQ ID NO: 75149 - protein, 128 aa, Homo sapiens
  Payload ID: 14849
  Gene Symbol: RIPPLY2
  Gene Name: ripply transcriptional repressor 2
  Uniprot ID: Q5TAB7
  ENSP ID: ENSP00000358703
MENAGGAEGTESGAAACAATDGPTRRAGADSGYAGFWRPWVDAGGKKEEETPNHAAEAMPDGPGMTAASGKLYQFRHPVRLFWPKSKCYDYLYQEAEALLKNFPIQATISFYEDSDSEDEIEDLTCEN

SEQ ID NO: 75150 - protein, 190 aa, Homo sapiens
  Payload ID: 14850
  Gene Symbol: RIPPLY3
  Gene Name: ripply transcriptional repressor 3
  Uniprot ID: P57055
  ENSP ID: ENSP00000331734
MEPEAAAGARKARGRGCHCPGDAPWRPPPPRGPESPAPWRPWIQTPGDAELTRTGRPLEPRADQHTFGSKGAFGFQHPVRVYLPMSKRQEYLRSSGEQVLASFPVQATIDFYDDESTESASEAEEPEEGPPPLHLLPQEVGGRQENGPGGKGRDQGINQGQRSSGGGDHWGEGPLPQGVSSRGGKCSSSK

SEQ ID NO: 75151 - protein, 476 aa, Homo sapiens
  Payload ID: 14851
  Gene Symbol: RNMT
  Gene Name: RNA (guanine-7-) methyltransferase
  Uniprot ID: O43148
  ENSP ID: ENSP00000262173
MANSAKAEEYEKMSLEQAKASVNSETESSFNINENTTASGTGLSEKTSVCRQVDIARKRKEFEDDLVKESSSCGKDTPSKKRKLDPEIVPEEKDCGDAEGNSKKRKRETEDVPKDKSSTGDGTQNKRKIALEDVPEKQKNLEEGHSSTVAAHYNELQEVGLEKRSQSRIFYLRNFNNWMKSVLIGEFLEKVRQKKKRDITVLDLGCGKGGDLLKWKKGRINKLVCTDIADVSVKQCQQRYEDMKNRRDSEYIFSAEFITADSSKELLIDKFRDPQMCFDICSCQFVCHYSFESYEQADMMLRNACERLSPGGYFIGTTPNSFELIRRLEASETESFGNEIYTVKFQKKGDYPLFGCKYDFNLEGVVDVPEFLVYFPLLNEMAKKYNMKLVYKKTFLEFYEEKIKNNENKMLLKRMQALEPYPANESSKLVSEKVDDYEHAAKYMKNSQVRLPLGTLSKSEWEATSIYLVFAFEKQQ

SEQ ID NO: 75152 - protein, 476 aa, Homo sapiens; identical to SEQ ID NO: 75151
  Payload ID: 14851
  Gene Symbol: RNMT
  Gene Name: RNA (guanine-7-) methyltransferase
  Uniprot ID: O43148
  ENSP ID: ENSP00000372804

SEQ ID NO: 75153 - protein, 476 aa, Homo sapiens; identical to SEQ ID NO: 75151
  Payload ID: 14851
  Gene Symbol: RNMT
  Gene Name: RNA (guanine-7-) methyltransferase
  Uniprot ID: O43148
  ENSP ID: ENSP00000446426

SEQ ID NO: 75154 - protein, 504 aa, Homo sapiens
  Payload ID: 14851
  Gene Symbol: RNMT
  Gene Name: RNA (guanine-7-) methyltransferase
  Uniprot ID: O43148
  ENSP ID: ENSP00000466111
MANSAKAEEYEKMSLEQAKASVNSETESSFNINENTTASGTGLSEKTSVCRQVDIARKRKEFEDDLVKESSSCGKDTPSKKRKLDPEIVPEEKDCGDAEGNSKKRKRETEDVPKDKSSTGDGTQNKRKIALEDVPEKQKNLEEGHSSTVAAHYNELQEVGLEKRSQSRIFYLRNFNNWMKSVLIGEFLEKVRQKKKRDITVLDLGCGKGGDLLKWKKGRINKLVCTDIADVSVKQCQQRYEDMKNRRDSEYIFSAEFITADSSKELLIDKFRDPQMCFDICSCQFVCHYSFESYEQADMMLRNACERLSPGGYFIGTTPNSFELIRRLEASETESFGNEIYTVKFQKKGDYPLFGCKYDFNLEGVVDVPEFLVYFPLLNEMAKKYNMKLVYKKTFLEFYEEKIKNNENKMLLKRMQALEPYPANESSKLVSEKVDDYEHAAKYMKNSQVRLPLGTLSKSEWEATRLTVTIMREAWLSTVGPGRAPVAASSVKWGTPRPAMQFIL

SEQ ID NO: 75155 - protein, 476 aa, Homo sapiens; identical to SEQ ID NO: 75151
  Payload ID: 14851
  Gene Symbol: RNMT
  Gene Name: RNA (guanine-7-) methyltransferase
  Uniprot ID: O43148
  ENSP ID: ENSP00000466252

SEQ ID NO: 75156 - protein, 298 aa, Homo sapiens
  Payload ID: 14851
  Gene Symbol: RNMT
  Gene Name: RNA (guanine-7-) methyltransferase
  ENSP ID: ENSP00000467171
MKSVLIGEFLEKVRQKKKRDITVLDLGCGKGGDLLKWKKGRINKLVCTDIADVSVKQCQQRYEDMKNRRDSEYIFSAEFITADSSKELLIDKFRDPQMCFDICSCQFVCHYSFESYEQADMMLRNACERLSPGGYFIGTTPNSFELIRRLEASETESFGNEIYTVKFQKKGDYPLFGCKYDFNLEGVVDVPEFLVYFPLLNEMAKKYNMKLVYKKTFLEFYEEKIKNNENKMLLKRMQALEPYPANESSKLVSEKVDDYEHAAKYMKNSQVRLPLGTLSKSEWEATSIYLVFAFEKQQ

SEQ ID NO: 75157 - protein, 101 aa, Homo sapiens
  Payload ID: 14851
  Gene Symbol: RNMT
  Gene Name: RNA (guanine-7-) methyltransferase
  ENSP ID: ENSP00000467475
MANSAKAEEYEKMSLEQAKASVNSETESSFNINENTTASGTGLSEKTSVCRQVDIARKRKEFEDDLVKESSSCGKDTPSKKRKLDPEIVPEEKDCGDAEGN

SEQ ID NO: 75158 - protein, 114 aa, Homo sapiens
  Payload ID: 14851
  Gene Symbol: RNMT
  Gene Name: RNA (guanine-7-) methyltransferase
  ENSP ID: ENSP00000468261
  MOD_RES (1)..(1): Any amino acid
XYEEKIKNNENKMLLKRMQALEDFHFFPQPYPANESSKLVSEKVDDYEHAAKYMKNSQVRLPLGTLSKSEWEATRLTVTIMREAWLSTVGPGRAPVAASSVKWGTPRPAMQFIL

SEQ ID NO: 75159 - protein, 505 aa, Homo sapiens
  Payload ID: 14852
  Gene Symbol: RTCB
  Gene Name: RNA 2',3'-cyclic phosphate and 5'-OH ligase
  Uniprot ID: Q9Y3I0
  ENSP ID: ENSP00000216038
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAKDLEEALEMGVDWSLREGYAWAEDKEHCEEYGRMLQADPNKVSARAKKRGLPQLGTLGAGNHYAEIQVVDEIFNEYAAKKMGIDHKGQVCVMIHSGSRGLGHQVATDALVAMEKAMKRDKIIVNDRQLACARIASPEGQDYLKGMAAAGNYAWVNRSSMTFLTRQAFAKVFNTTPDDLDLHVIYDVSHNIAKVEQHVVDGKERTLLVHRKGSTRAFPPHHPLIAVDYQLTGQPVLIGGTMGTCSYVLTGTEQGMTETFGTTCHGAGRALSRAKSRRNLDFQDVLDKLADMGIAIRVASPKLVMEEAPESYKNVTDVVNTCHDAGISKKAIKLRPIAVIKG

SEQ ID NO: 75160 - protein, 379 aa, Homo sapiens
  Payload ID: 14853
  Gene Symbol: RTCA
  Gene Name: RNA 3'-terminal phosphate cyclase
  Uniprot ID: O00442
  ENSP ID: ENSP00000260563
MAGPRVEVDGSIMEGGGQILRVSTALSCLLGLPLRVQKIRAGRSTPGLSSGGWKSKIKVLTRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIIAETSTGCLFAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 75161 - protein, 49 aa, Homo sapiens
  Payload ID: 14853
  Gene Symbol: RTCA
  Gene Name: RNA 3'-terminal phosphate cyclase
  ENSP ID: ENSP00000359144
MAGPRVEVDGSIMEGGGQILRVSTALSCLLGLPLRVQKIRAGRSTPGLR

SEQ ID NO: 75162 - protein, 366 aa, Homo sapiens
  Payload ID: 14853
  Gene Symbol: RTCA
  Gene Name: RNA 3'-terminal phosphate cyclase
  Uniprot ID: O00442
  ENSP ID: ENSP00000359146
MAGPRVEVDGSIMEGGGQILRVSTALSCLLGLPLRVQKIRAGRSTPGLRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIIAETSTGCLFAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 75163 - protein, 155 aa, Homo sapiens
  Payload ID: 14854
  Gene Symbol: RBM3
  Gene Name: RNA binding motif (RNP1, RRM) protein 3
  ENSP ID: ENSP00000346473
MAPRTWCPAGIFGLFCPLTLACSSLTIALTDCQPIILVSPTLSLWMVVRSVWIMQASLLGEPEEVALGPMGVVAATLEVVGTRAMGVAGIMTVDLEGMDMDMDVPETIMAETRVVMTATQEEITETIMTTEMRHAHNIGETWISALSEPVCHTLS

SEQ ID NO: 75164 - protein, 157 aa, Homo sapiens
  Payload ID: 14854
  Gene Symbol: RBM3
  Gene Name: RNA binding motif (RNP1, RRM) protein 3
  Uniprot ID: P98179
  ENSP ID: ENSP00000365946
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 75165 - protein, 157 aa, Homo sapiens; identical to SEQ ID NO: 75164
  Payload ID: 14854
  Gene Symbol: RBM3
  Gene Name: RNA binding motif (RNP1, RRM) protein 3
  Uniprot ID: P98179
  ENSP ID: ENSP00000365950

SEQ ID NO: 75166 - protein, 995 aa, Homo sapiens
  Payload ID: 14855
  Gene Symbol: RBM10
  Gene Name: RNA binding motif protein 10
  ENSP ID: ENSP00000328848
MSGSPSLTARAEKVSVDAGRGGGESLQEASPRLADHGSSSGGGWEVKRSQRLRRGPSSPRRPYQDMEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 75167 - protein, 853 aa, Homo sapiens
  Payload ID: 14855
  Gene Symbol: RBM10
  Gene Name: RNA binding motif protein 10
  Uniprot ID: P98175
  ENSP ID: ENSP00000329659
MEYERRGGRGDRTGRYGATDRSQDDGGENRSRDHDYRDMDYRSYPREYGSQEGKHDYDDSSEEQSAEIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 75168 - protein, 930 aa, Homo sapiens
  Payload ID: 14855
  Gene Symbol: RBM10
  Gene Name: RNA binding motif protein 10
  Uniprot ID: P98175
  ENSP ID: ENSP00000366829
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIVEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 75169 - protein, 852 aa, Homo sapiens
  Payload ID: 14855
  Gene Symbol: RBM10
  Gene Name: RNA binding motif protein 10
  Uniprot ID: P98175
  ENSP ID: ENSP00000486115
MEYERRGGRGDRTGRYGATDRSQDDGGENRSRDHDYRDMDYRSYPREYGSQEGKHDYDDSSEEQSAEIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRAQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 75170 - protein, 281 aa, Homo sapiens
  Payload ID: 14856
  Gene Symbol: RBM11
  Gene Name: RNA binding motif protein 11
  Uniprot ID: P57052
  ENSP ID: ENSP00000383421
MFPAQEEADRTVFVGNLEARVREEILYELFLQAGPLTKVTICKDREGKPKSFGFVCFKHPESVSYAIALLNGIRLYGRPINVQYRFGSSRSSEPANQSFESCVKINSHNYRNEEMLVGRSSFPMQYFPINNTSLPQEYFLFQKMQWHVYNPVLQLPYYEMTAPLPNSASVSSSLNHVPDLEAGPSSYKWTHQQPSDSDLYQMTAPLPNSASVSSSLNHVPDLEAGPSSYKWTHQQPSDSDLYQMNKRKRQKQTSDSDSSTDNNRGNECSQKFRKSKKKKRY

SEQ ID NO: 75171 - protein, 932 aa, Homo sapiens
  Payload ID: 14857
  Gene Symbol: RBM12
  Gene Name: RNA binding motif protein 12
  Uniprot ID: Q9NTZ6
  ENSP ID: ENSP00000352668
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQSSVKPLPINPDDLYVSVHGMPFSAMENDVRDFFHGLRVDAVHLLKDHVGRNNGNGLVKFLSPQDTFEALKRNRMLMIQRYVEVSPATERQWVAAGGHITFKQNMGPSGQTHPPPQTLPRSKSPSGQKRSRSRSPHEAGFCVYLKGLPFEAENKHVIDFFKKLDIVEDSIYIAYGPNGKATGEGFVEFRNEADYKAALCRHKQYMGNRFIQVHPITKKGMLEKIDMIRKRLQNFSYDQREMILNPEGDVNSAKVCAHITNIPFSITKMDVLQFLEGIPVDENAVHVLVDNNGQGLGQALVQFKNEDDARKSERLHRKKLNGREAFVHVVTLEDMREIEKNPPAQGKKGLKMPVPGNPAVPGMPNAGLPGVGLPSAGLPGAGLPSTGLPGSAITSAGLPGAGMPSAGIPSAGGEEHAFLTVGSKEANNGPPFNFPGNFGGSNAFGPPIPPPGLGGGAFGDARPGMPSVGNSGLPGLGLDVPGFGGGPNNLSGPSGFGGGPQNFGNGPGSLGGPPGFGSGPPGLGSAPGHLGGPPAFGPGPGPGPGPGPIHIGGPPGFASSSGKPGPTVIKVQNMPFTVSIDEILDFFYGYQVIPGSVCLKYNEKGMPTGEAMVAFESRDEATAAVIDLNDRPIGSRKVKLVLG

SEQ ID NO: 75172 - protein, 932 aa, Homo sapiens; identical to SEQ ID NO: 75171
  Payload ID: 14857
  Gene Symbol: RBM12
  Gene Name: RNA binding motif protein 12
  Uniprot ID: Q9NTZ6
  ENSP ID: ENSP00000363217

SEQ ID NO: 75173 - protein, 932 aa, Homo sapiens; identical to SEQ ID NO: 75171
  Payload ID: 14857
  Gene Symbol: RBM12
  Gene Name: RNA binding motif protein 12
  Uniprot ID: Q9NTZ6
  ENSP ID: ENSP00000363228

SEQ ID NO: 75174 - protein, 143 aa, Homo sapiens
  Payload ID: 14857
  Gene Symbol: RBM12
  Gene Name: RNA binding motif protein 12
  ENSP ID: ENSP00000392642
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHES

SEQ ID NO: 75175 - protein, 291 aa, Homo sapiens
  Payload ID: 14857
  Gene Symbol: RBM12
  Gene Name: RNA binding motif protein 12
  ENSP ID: ENSP00000411036
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVVTATTSVHESNKNIQTFSTASVGTAPPNMGASFGSPTFSSTVPSTASPMNTVPPPPIPPIPAMPSLPPMPSIPPIPVPPPVPTLPPVPPVPPIPPVPSVPPMTPLPPMSGMPPLNPPPVAPLPAGMNGSGAPMNLNNNLNPMFLGPLNPVNPIQMNSQ

SEQ ID NO: 75176 - protein, 134 aa, Homo sapiens
  Payload ID: 14857
  Gene Symbol: RBM12
  Gene Name: RNA binding motif protein 12
  ENSP ID: ENSP00000411692
MAVVIRLQGLPIVAGTMDIRHFFSGLTIPDGGVHIVGGELGEAFIVFATDEDARLGMMRTGGTIKGSKVTLLLSSKTEMQNMIELSRRRFETANLDIPPANASRSGPPPSSGMSSRVNLPTTVSNFNNPSPSVV

SEQ ID NO: 75177 - protein, 1001 aa, Homo sapiens
  Payload ID: 14858
  Gene Symbol: RBM12B
  Gene Name: RNA binding motif protein 12B
  Uniprot ID: Q8IXT5
  ENSP ID: ENSP00000382239
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRPLKAENPYLFLRGLPYLVNEDDVRVFFSGLCVDGVIFLKHHDGRNNGDAIVKFASCVDASGGLKCHRSFMGSRFIEVMQGSEQQWIEFGGNAVKEGDVLRRSEEHSPPRGINDRHFRKRSHSKSPRRTRSRSPLGFYVHLKNLSLSIDERDLRNFFRGTDLTDEQIRFLYKDENRTRYAFVMFKTLKDYNTALSLHKTVLQYRPVHIDPISRKQMLKFIARYEKKRSGSLERDRPGHVSQKYSQEGNSGQKLCIYIRNFPFDVTKVEVQKFFADFLLAEDDIYLLYDDKGVGLGEALVKFKSEEQAMKAERLNRRRFLGTEVLLRLISEAQIQEFGVNFSVMSSEKMQARSQSRERGDHSHLFDSKDPPIYSVGAFENFRHQLEDLRQLDNFKHPQRDFRQPDRHPPEDFRHSSEDFRFPPEDFRHSPEDFRRPREEDFRRPSEEDFRRPWEEDFRRPPEDDFRHPREEDWRRPLEEDWRRPLEEDFRRSPTEDFRQLPEEDFRQPPEEDLRWLPEEDFRRPPEEDWRRPPEEDFRRPLQGEWRRPPEDDFRRPPEEDFRHSPEEDFRQSPQEHFRRPPQEHFRRPPPEHFRRPPPEHFRRPPPEHFRRPPPEHFRRPPPEHFRRPPPEHFRRPPQEHFRRPPQEHFRRSREEDFRHPPDEDFRGPPDEDFRHPPDEDFRSPQEEDFRCPSDEDFRQLPEEDLREAPEEDPRLPDNFRPPGEDFRSPPDDFRSHRPFVNFGRPEGGKFDFGKHNMGSFPEGRFMPDPKINCGSGRVTPIKIMNLPFKANVNEILDFFHGYRIIPDSVSIQYNEQGLPTGEAIVAMINYNEAMAAIKDLNDRPVGPRKVKLTLL

SEQ ID NO: 75178 - protein, 881 aa, Homo sapiens
  Payload ID: 14858
  Gene Symbol: RBM12B
  Gene Name: RNA binding motif protein 12B
  ENSP ID: ENSP00000427729
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRPLKAENPYLFLRGLPYLVNEDDVRVFFSGLCVDGVIFLKHHDGRNNGDAIVKFASCVDASGGLKCHRSFMGSRFIEVMQGSEQQWIEFGGNAVKEGDVLRRSEEHSPPRGINDRHFRKRSHSKSPRRTRSRSPLGFYVHLKNLSLSIDERDLRNFFRGTDLTDEQIRFLYKDENRTRYAFVMFKTLKDYNTALSLHKTVLQYRPVHIDPISRKQMLKFIARYEKKRSGSLERDRPGHVSQKYSQEGNSGQKLCIYIRNFPFDVTKVEVQKFFADFLLAEDDIYLLYDDKGVGLGEALVKFKSEEQAMKAERLNRRRFLGTEVLLRLISEAQIQEFGVNFSVMSSEKMQARSQSRERGDHSHLFDSKDPPIYSVGAFENFRHQLEDLRQLDNFKHPQRDFRQPDRHPPEDFRHSSEDFRFPPEDFRHSPEDFRRPREEDFRRPSEEDFRRPWEEDFRRPPEDDFRHPREEDWRRPPPEHFRRPPPEHFRRPPPEHFRRPPPEHFRRPPPEHFRRPPQEHFRRPPQEHFRRSREEDFRHPPDEDFRGPPDEDFRHPPDEDFRSPQEEDFRCPSDEDFRQLPEEDLREAPEEDPRLPDNFRPPGEDFRSPPDDFRSHRPFVNFGRPEGGKFDFGKHNMGSFPEGRFMPDPKINCGSGRVTPIKIMNLPFKANVNEILDFFHGYRIIPDSVSIQYNEQGLPTGEAIVAMINYNEAMAAIKDLNDRPVGPRKVKLTLL

SEQ ID NO: 75179 - protein, 143 aa, Homo sapiens
  Payload ID: 14858
  Gene Symbol: RBM12B
  Gene Name: RNA binding motif protein 12B
  ENSP ID: ENSP00000428269
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLR

SEQ ID NO: 75180 - protein, 122 aa, Homo sapiens
  Payload ID: 14858
  Gene Symbol: RBM12B
  Gene Name: RNA binding motif protein 12B
  ENSP ID: ENSP00000429807
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGY

SEQ ID NO: 75181 - protein, 82 aa, Homo sapiens
  Payload ID: 14858
  Gene Symbol: RBM12B
  Gene Name: RNA binding motif protein 12B
  ENSP ID: ENSP00000430466
MAVVIRLLGLPFIAGPVDIRHFFTGLTIPDGGVHIIGGEIGEAFIIFATDEDARRAISRSGGFIKDSSVELFLSSKAEMQKT

SEQ ID NO: 75182 - protein, 149 aa, Homo sapiens
  Payload ID: 14858
  Gene Symbol: RBM12B
  Gene Name: RNA binding motif protein 12B
  ENSP ID: ENSP00000430474
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRP

SEQ ID NO: 75183 - protein, 881 aa, Homo sapiens; identical to SEQ ID NO: 75178
  Payload ID: 14858
  Gene Symbol: RBM12B
  Gene Name: RNA binding motif protein 12B
  ENSP ID: ENSP00000487257

SEQ ID NO: 75184 - protein, 669 aa, Homo sapiens
  Payload ID: 14859
  Gene Symbol: RBM14
  Gene Name: RNA binding motif protein 14
  Uniprot ID: Q96PK6
  ENSP ID: ENSP00000311747
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 75185 - protein, 156 aa, Homo sapiens
  Payload ID: 14859
  Gene Symbol: RBM14
  Gene Name: RNA binding motif protein 14
  Uniprot ID: Q96PK6
  ENSP ID: ENSP00000377548
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGMVPTGV

SEQ ID NO: 75186 - protein, 159 aa, Homo sapiens
  Payload ID: 14859
  Gene Symbol: RBM14
  Gene Name: RNA binding motif protein 14
  ENSP ID: ENSP00000386518
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGDVKIFILCCSSSLLLLLSPGSWTTRLFTWRRKQMPKPQSRSSTAKK

SEQ ID NO: 75187 - protein, 119 aa, Homo sapiens
  Payload ID: 14859
  Gene Symbol: RBM14
  Gene Name: RNA binding motif protein 14
  Uniprot ID: Q96PK6
  ENSP ID: ENSP00000386995
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGMVPTGV

SEQ ID NO: 75188 - protein, 129 aa, Homo sapiens
  Payload ID: 14859
  Gene Symbol: RBM14
  Gene Name: RNA binding motif protein 14
  ENSP ID: ENSP00000414650
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGYTSPRLSGIGLSCWVL

SEQ ID NO: 75189 - protein, 977 aa, Homo sapiens
  Payload ID: 14860
  Gene Symbol: RBM15
  Gene Name: RNA binding motif protein 15
  Uniprot ID: Q96T37
  ENSP ID: ENSP00000358799
MRTAGRDPVPRRSPRWRRAVPLCETSAGRRVTQLRGDDLRRPATMKGKERSPVKAKRSRGGEDSTSRGERSKKLGGSGGSNGSSSGKTDSGGGSRRSLHLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDRRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRGFGFQIGVRYENKKRENLALTLL

SEQ ID NO: 75190 - protein, 969 aa, Homo sapiens
  Payload ID: 14860
  Gene Symbol: RBM15
  Gene Name: RNA binding motif protein 15
  Uniprot ID: Q96T37
  ENSP ID: ENSP00000473552
MRTAGRDPVPRRSPRWRRAVPLCETSAGRRVTQLRGDDLRRPATMKGKERSPVKAKRSRGGEDSTSRGERSKKLGGSGGSNGSSSGKTDSGGGSRRSLHLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDRRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRAKLVEQRMKIWNSKL

SEQ ID NO: 75191 - protein, 957 aa, Homo sapiens
  Payload ID: 14860
  Gene Symbol: RBM15
  Gene Name: RNA binding motif protein 15
  Uniprot ID: Q96T37
  ENSP ID: ENSP00000473638
MRTAGRDPVPRRSPRWRRAVPLCETSAGRRVTQLRGDDLRRPATMKGKERSPVKAKRSRGGEDSTSRGERSKKLGGSGGSNGSSSGKTDSGGGSRRSLHLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDRRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRGAS

SEQ ID NO: 75192 - protein, 933 aa, Homo sapiens
  Payload ID: 14860
  Gene Symbol: RBM15
  Gene Name: RNA binding motif protein 15
  ENSP ID: ENSP00000480399
MKGKERSPVKAKRSRGGEDSTSRGERSKKLGGSGGSNGSSSGKTDSGGGSRRSLHLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDRRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRGFGFQIGVRYENKKRENLALTLL

SEQ ID NO: 75193 - protein, 977 aa, Homo sapiens; identical to SEQ ID NO: 75189
  Payload ID: 14860
  Gene Symbol: RBM15
  Gene Name: RNA binding motif protein 15
  Uniprot ID: Q96T37
  ENSP ID: ENSP00000483133

SEQ ID NO: 75194 - protein, 890 aa, Homo sapiens
  Payload ID: 14861
  Gene Symbol: RBM15B
  Gene Name: RNA binding motif protein 15B
  Uniprot ID: Q8NDT2
  ENSP ID: ENSP00000454545
MKRQSERDSSPSGRGSSSSAKRPREREREAEAGGRRAAHKASGGAKHPVPARARDKPRGSGSGGGGHRDGRGTGDANHRASSGRSSGSGAGGGGRGGKASGDPGASGMSPRASPLPPPPPPPGAEPACPGSSAAAPEYKTLLISSLSPALPAEHLEDRLFHQFKRFGEISLRLSHTPELGRVAYVNFRHPQDAREARQHALARQLLLYDRPLKVEPVYLRGGGGSSRRSSSSSAAASTPPPGPPAPADPLGYLPLHGGYQYKQRSLSPVAAPPLREPRARHAAAAFALDAAAAAAVGLSRERALDYYGLYDDRGRPYGYPAVCEEDLMPEDDQRATRNLFIGNLDHSVSEVELRRAFEKYGIIEEVVIKRPARGQGGAYAFLKFQNLDMAHRAKVAMSGRVIGRNPIKIGYGKANPTTRLWVGGLGPNTSLAALAREFDRFGSIRTIDHVKGDSFAYIQYESLDAAQAACAKMRGFPLGGPDRRLRVDFAKAEETRYPQQYQPSPLPVHYELLTDGYTRHRNLDADLVRDRTPPHLLYSDRDRTFLEGDWTSPSKSSDRRNSLEGYSRSVRSRSGERWGADGDRGLPKPWEERRKRRSLSSDRGRTTHSPYEERSRTKGSGQQSERGSDRTPERSRKENHSSEGTKESSSNSLSNSRHGAEERGHHHHHHEAADSSHGKKARDSERNHRTTEAEPKPLEEPKHETKKLKNLSEYAQTLQLGWNGLLVLKNSCFPTSMHILEGDQGVISSLLKDHTSGSKLTQLKIAQRLRLDQPKLDEVTRRIKQGSPNGYAVLLATQATPSGLGTEGMPTVEPGLQRRLLRNLVSYLKQKQAAGVISLPVGGSKGRDGTGMLYAFPPCDFSQQYLQSALRTLGKLEEEHMVIVIVRDTA

SEQ ID NO: 75195 - protein, 401 aa, Homo sapiens
  Payload ID: 14862
  Gene Symbol: RBM17
  Gene Name: RNA binding motif protein 17
  Uniprot ID: Q96I25
  ENSP ID: ENSP00000369218
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 75196 - protein, 401 aa, Homo sapiens; identical to SEQ ID NO: 75195
  Payload ID: 14862
  Gene Symbol: RBM17
  Gene Name: RNA binding motif protein 17
  Uniprot ID: Q96I25
  ENSP ID: ENSP00000388638

SEQ ID NO: 75197 - protein, 240 aa, Homo sapiens
  Payload ID: 14862
  Gene Symbol: RBM17
  Gene Name: RNA binding motif protein 17
  ENSP ID: ENSP00000395448
MGRVGRAGRSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSK

SEQ ID NO: 75198 - protein, 212 aa, Homo sapiens
  Payload ID: 14862
  Gene Symbol: RBM17
  Gene Name: RNA binding motif protein 17
  ENSP ID: ENSP00000402303
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPP

SEQ ID NO: 75199 - protein, 225 aa, Homo sapiens
  Payload ID: 14862
  Gene Symbol: RBM17
  Gene Name: RNA binding motif protein 17
  ENSP ID: ENSP00000406024
  MOD_RES (1)..(1): Any amino acid
XPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKGVSPGKRVTRGKGLAPSISDMASLDPHVSAGGQ

SEQ ID NO: 75200 - protein, 221 aa, Homo sapiens
  Payload ID: 14862
  Gene Symbol: RBM17
  Gene Name: RNA binding motif protein 17
  ENSP ID: ENSP00000408214
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRKDRHEASGFARRPDPDSDEDEDYERERRKRSMGGAAIAPPTSLVEKDKELPRDFPYEEDSRPRSQSSKAAIPPPVYEEQDRPRS

SEQ ID NO: 75201 - protein, 190 aa, Homo sapiens
  Payload ID: 14863
  Gene Symbol: RBM18
  Gene Name: RNA binding motif protein 18
  Uniprot ID: Q96H35
  ENSP ID: ENSP00000409315
MEAETKTLPLENASILSEGSLQEGHRLWIGNLDPKITEYHLLKLLQKFGKVKQFDFLFHKSGALEGQPRGYCFVNFETKQEAEQAIQCLNGKLALSKKLVVRWAHAQVKRYDHNKNDKILPISLEPSSSTEPTQSNLSVTAKIKAIEAKLKMMAENPDAEYPAAPVYSYFKPPDKKRTTPYSRTAWKSRR

SEQ ID NO: 75202 - protein, 960 aa, Homo sapiens
  Payload ID: 14864
  Gene Symbol: RBM19
  Gene Name: RNA binding motif protein 19
  Uniprot ID: Q9Y4C8
  ENSP ID: ENSP00000261741
MSRLIVKNLPNGMKEERFRQLFAAFGTLTDCSLKFTKDGKFRKFGFIGFKSEEEAQKAQKHFNKSFIDTSRITVEFCKSFGDPAKPRAWSKHAQKPSQPKQPPKDSTTPEIKKDEKKKKVAGQLEKLKEDTEFQEFLSVHQRRAQAATWANDGLDAEPSKGKSKPASDYLNFDSDSGQESEEEGAGEDLEEEASLEPKAAVQKELSDMDYLKSKMVKAGSSSSSEEEESEDEAVHCDEGSEAEEEDSSATPVLQERDSKGAGQEQGMPAGKKRPPEARAETEKPANQKEPTTCHTVKLRGAPFNVTEKNVMEFLAPLKPVAIRIVRNAHGNKTGYIFVDFSNEEEVKQALKCNREYMGGRYIEVFREKNVPTTKGAPKNTTKSWQGRILGENEEEEDLAESGRLFVRNLPYTSTEEDLEKLFSKYGPLSELHYPIDSLTKKPKGFAFITFMFPEHAVKAYSEVDGQVFQGRMLHVLPSTIKKEASEDASALGSSSYKKKKEAQDKANSASSHNWNTLFMGPNAVADAIAQKYNATKSQVFDHETKGSVAVRVALGETQLVQEVRRFLIDNGVSLDSFSQAAAERSKTVILVKNLPAGTLAAQLQETFGHFGSLGRVLLPEGGITAIVEFLEPLEARKAFRHLAYSKFHHVPLYLEWAPVGVFSSTAPQKKKLQDTPSEPMEKDPAEPETVPDGETPEDENPTEEGADNSSAKMEEEEEEEEEEEESLPGCTLFIKNLNFDTTEEKLKEVFSKVGTVKSCSISKKKNKAGVLLSMGFGFVEYRKPEQAQKALKQLQGHVVDGHKLEVRISERATKPAVTLARKKQVPRKQTTSKILVRNIPFQAHSREIRELFSTFGELKTVRLPKKMTGTGTHRGFGFVDFLTKQDAKRAFNALCHSTHLYGRRLVLEWADSEVTLQALRRKTAAHFHEPPKKKRSVVLDEILEQLEGSDSDSEEQTLQL

SEQ ID NO: 75203 - protein, 960 aa, Homo sapiens; identical to SEQ ID NO: 75202
  Payload ID: 14864
  Gene Symbol: RBM19
  Gene Name: RNA binding motif protein 19
  Uniprot ID: Q9Y4C8
  ENSP ID: ENSP00000376344

SEQ ID NO: 75204 - protein, 960 aa, Homo sapiens; identical to SEQ ID NO: 75202
  Payload ID: 14864
  Gene Symbol: RBM19
  Gene Name: RNA binding motif protein 19
  Uniprot ID: Q9Y4C8
  ENSP ID: ENSP00000442053

SEQ ID NO: 75205 - protein, 110 aa, Homo sapiens
  Payload ID: 14864
  Gene Symbol: RBM19
  Gene Name: RNA binding motif protein 19
  ENSP ID: ENSP00000449604
VSSTFGELKTVRLPKKMTGTGTHRGFGFVDFLTKQDAKRAFNALCHSTHLYGRRLVLEWADSEVTLQALRRKTAAHFHEPPKKKRSVVLDEILEQLEGSDSDSEEQTLQL

SEQ ID NO: 75206 - protein, 1227 aa, Homo sapiens
  Payload ID: 14865
  Gene Symbol: RBM20
  Gene Name: RNA binding motif protein 20
  Uniprot ID: Q5T481
  ENSP ID: ENSP00000358532
MVLAAAMSQDADPSGPEQPDRVACSVPGARASPAPSGPRGMQQPPPPPQPPPPPQAGLPQIIQNAAKLLDKNPFSVSNPNPLLPSPASLQLAQLQAQLTLHRLKLAQTAVTNNTAAATVLNQVLSKVAMSQPLFNQLRHPSVITGPHGHAGVPQHAAAIPSTRFPSNAIAFSPPSQTRGPGPSMNLPNQPPSAMVMHPFTGVMPQTPGQPAVILGIGKTGPAPATAGFYEYGKASSGQTYGPETDGQPGFLPSSASTSGSVTYEGHYSHTGQDGQAAFSKDFYGPNSQGSHVASGFPAEQAGGLKSEVGPLLQGTNSQWESPHGFSGQSKPDLTAGPMWPPPHNQPYELYDPEEPTSDRTPPSFGGRLNNSKQGFIGAGRRAKEDQALLSVRPLQAHELNDFHGVAPLHLPHICSICDKKVFDLKDWELHVKGKLHAQKCLVFSENAGIRCILGSAEGTLCASPNSTAVYNPAGNEDYASNLGTSYVPIPARSFTQSSPTFPLASVGTTFAQRKGAGRVVHICNLPEGSCTENDVINLGLPFGKVTNYILMKSTNQAFLEMAYTEAAQAMVQYYQEKSAVINGEKLLIRMSKRYKELQLKKPGKAVAAIIQDIHSQRERDMFREADRYGPERPRSRSPVSRSLSPRSHTPSFTSCSSSHSPPGPSRADWGNGRDSWEHSPYARREEERDPAPWRDNGDDKRDRMDPWAHDRKHHPRQLDKAELDERPEGGRPHREKYPRSGSPNLPHSVSSYKSREDGYYRKEPKAKSDKYLKQQQDAPGRSRRKDEARLRESRHPHPDDSGKEDGLGPKVTRAPEGAKAKQNEKNKTKRTDRDQEGADDRKENTMAENEAGKEEQEGMEESPQSVGRQEKEAEFSDPENTRTKKEQDWESESEAEGESWYPTNMEELVTVDEVGEEEDFIVEPDIPELEEIVPIDQKDKICPETCLCVTTTLDLDLAQDFPKEGVKAVGNGAAEISLKSPRELPSASTSCPSDMDVEMPGLNLDAERKPAESETGLSLEDSDCYEKEAKGVESSDVHPAPTVQQMSSPKPAEERARQPSPFVDDCKTRGTPEDGACEGSPLEEKASPPIETDLQNQACQEVLTPENSRYVEMKSLEVRSPEYTEVELKQPLSLPSWEPEDVFSELSIPLGVEFVVPRTGFYCKLCGLFYTSEETAKMSHCRSAVHYRNLQKYLSQLAEEGLKETEGADSPRPEDSGIVPRFERKKL

SEQ ID NO: 75207 - protein, 420 aa, Homo sapiens
  Payload ID: 14866
  Gene Symbol: RBM22
  Gene Name: RNA binding motif protein 22
  Uniprot ID: Q9NW64
  ENSP ID: ENSP00000199814
MATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 75208 - protein, 371 aa, Homo sapiens
  Payload ID: 14866
  Gene Symbol: RBM22
  Gene Name: RNA binding motif protein 22
  Uniprot ID: Q9NW64
  ENSP ID: ENSP00000412118
MATSLGSNTYNRQNWEDADFPILCQTCLGENPYIRMTKEKYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 75209 - protein, 179 aa, Homo sapiens
  Payload ID: 14866
  Gene Symbol: RBM22
  Gene Name: RNA binding motif protein 22
  ENSP ID: ENSP00000428154
MATSLGSNTYNRQNWEDATCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKP

SEQ ID NO: 75210 - protein, 243 aa, Homo sapiens
  Payload ID: 14866
  Gene Symbol: RBM22
  Gene Name: RNA binding motif protein 22
  ENSP ID: ENSP00000430946
MEGGGEAAHLASWQDRACGAAEGIPGRSQRGGLAWPEQEGGGRSSCGLEGRGLSQGPGTSTLSIPAPSSLLELVFFSPAACRKCRQRPLPRSGRDGLRVPAVPSSPPSLPAPSPPQVSLRCQGLRRVVLNQISHFHQDFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMERE

SEQ ID NO: 75211 - protein, 405 aa, Homo sapiens
  Payload ID: 14867
  Gene Symbol: RBM23
  Gene Name: RNA binding motif protein 23
  Uniprot ID: Q86U06
  ENSP ID: ENSP00000339220
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGEPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 75212 - protein, 439 aa, Homo sapiens
  Payload ID: 14867
  Gene Symbol: RBM23
  Gene Name: RNA binding motif protein 23
  Uniprot ID: Q86U06
  ENSP ID: ENSP00000352956
MASDDFDIVIEAMLEAPYKKEEDEQQRKEVKKDYPSNTTSSTSNSGNETSGSSTIGETSKKKRSRSHNKSRDRKRSRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 75213 - protein, 423 aa, Homo sapiens
  Payload ID: 14867
  Gene Symbol: RBM23
  Gene Name: RNA binding motif protein 23
  Uniprot ID: Q86U06
  ENSP ID: ENSP00000382806
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRDHRREDRVHYRSPPLATGYRYGHSKSPHFREKSPVREPVDNLSPEERDARTVFCMQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 75214 - protein, 269 aa, Homo sapiens
  Payload ID: 14867
  Gene Symbol: RBM23
  Gene Name: RNA binding motif protein 23
  ENSP ID: ENSP00000438504
MQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 75215 - protein, 21 aa, Homo sapiens
  Payload ID: 14867
  Gene Symbol: RBM23
  Gene Name: RNA binding motif protein 23
  ENSP ID: ENSP00000450423
MQLAARIRPRDLEDFFSAVGK

SEQ ID NO: 75216 - protein, 50 aa, Homo sapiens
  Payload ID: 14867
  Gene Symbol: RBM23
  Gene Name: RNA binding motif protein 23
  ENSP ID: ENSP00000450556
MQLAARIRPRDLEDFFSAVGKVRDVRIISDRNSRRSKGIAYVEFCEIQSV

SEQ ID NO: 75217 - protein, 101 aa, Homo sapiens
  Payload ID: 14867
  Gene Symbol: RBM23
  Gene Name: RNA binding motif protein 23
  ENSP ID: ENSP00000450558
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSRD

SEQ ID NO: 75218 - protein, 59 aa, Homo sapiens
  Payload ID: 14867
  Gene Symbol: RBM23
  Gene Name: RNA binding motif protein 23
  ENSP ID: ENSP00000450672
MASDDFDIVIEAMLEAPYKKEEDEQQRKEVKKDYPSNTTSSTSNSGNETSGSSTIGETS

SEQ ID NO: 75219 - protein, 100 aa, Homo sapiens
  Payload ID: 14867
  Gene Symbol: RBM23
  Gene Name: RNA binding motif protein 23
  ENSP ID: ENSP00000451364
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSR

SEQ ID NO: 75220 - protein, 66 aa, Homo sapiens
  Payload ID: 14867
  Gene Symbol: RBM23
  Gene Name: RNA binding motif protein 23
  ENSP ID: ENSP00000451403
MASDDFDIVIEAMLEAPYKKEEDEQQRKEVKKDYPSNTTSSTSNSGNETSGSSTIGETSNRSRDRD

SEQ ID NO: 75221 - protein, 75 aa, Homo sapiens
  Payload ID: 14867
  Gene Symbol: RBM23
  Gene Name: RNA binding motif protein 23
  ENSP ID: ENSP00000451448
MASDDFDIVIEAMLEAPYKKEEDEQQRKEVKKDYPSNTTSSTSNSGNETSGSSTIGETSKKKRSRSHNKSRDRKR

SEQ ID NO: 75222 - protein, 214 aa, Homo sapiens
  Payload ID: 14867
  Gene Symbol: RBM23
  Gene Name: RNA binding motif protein 23
  ENSP ID: ENSP00000451642
  MOD_RES (1)..(1): Any amino acid
XADWAAVAGSAYHCTGFTEKNRLAAMANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 75223 - protein, 82 aa, Homo sapiens
  Payload ID: 14867
  Gene Symbol: RBM23
  Gene Name: RNA binding motif protein 23
  ENSP ID: ENSP00000451838
LDLGSAGGRFQLMAKLAEGAGIQLPSTAAAAAAAAAQAAALQLNGAVPLGALNPAALTALSPALNLASQCFQLSSLFTPQTM

SEQ ID NO: 75224 - protein, 114 aa, Homo sapiens
  Payload ID: 14867
  Gene Symbol: RBM23
  Gene Name: RNA binding motif protein 23
  ENSP ID: ENSP00000452171
MQLAARIRPRDLEDFFSAVGKVRDVRIISDRNSRRSKGIAYVEFCEIQSVPLAIGLTGQRLLGVPIIVQASQAEKNRLAAMANNLQKGNGGPMRLYVGSLHFNITEDMLRGIFE

SEQ ID NO: 75225 - protein, 91 aa, Homo sapiens
  Payload ID: 14867
  Gene Symbol: RBM23
  Gene Name: RNA binding motif protein 23
  ENSP ID: ENSP00000452382
MASDDFDIVIEAMLEAPYKKEEDEQQRKEVKKDYPSNTTSSTSNSGNETSGSSTIGETSNRSRDRDRYRRRNSRSRSPGRQCRHRSRSWDR

SEQ ID NO: 75226 - protein, 57 aa, Homo sapiens
  Payload ID: 14867
  Gene Symbol: RBM23
  Gene Name: RNA binding motif protein 23
  ENSP ID: ENSP00000452538
MASDDFDIVIEAMLEAPYKKEEDEQQRKEVKKDYPSNTTSSTSNSGNETSGSSTIGE

SEQ ID NO: 75227 - protein, 92 aa, Homo sapiens
  Payload ID: 14867
  Gene Symbol: RBM23
  Gene Name: RNA binding motif protein 23
  ENSP ID: ENSP00000452557
MASDDFDIVIEAMLEAPYKKEEDEQQRKEVKKDYPSNTTSSTSNSGNETSGSSTIGETSKKKRSRSHNKSRDRKRSRSRDRDRYRRRNSRSR

SEQ ID NO: 75228 - protein, 144 aa, Homo sapiens
  Payload ID: 14867
  Gene Symbol: RBM23
  Gene Name: RNA binding motif protein 23
  ENSP ID: ENSP00000452583
MASDDFDIVIEAMLEAPYKKEEDEQQRKEVKKDYPSNTTSSTSNSGNETSGSSTIGETSKKKRSRSHNKSRDRKRSRSRDRDRYRRRNSRSRSPGRQCRHRSRSWDRRHGSESRSRDHRREDRVHYRSPPLATGEPVDNLSPEE

SEQ ID NO: 75229 - protein, 189 aa, Homo sapiens
  Payload ID: 14867
  Gene Symbol: RBM23
  Gene Name: RNA binding motif protein 23
  ENSP ID: ENSP00000452602
MANNLQKGNGGPMRLYVGSLHFNITEDMLRGIFEPFGKIDNIVLMKDSDTGRSKGYGFITFSDSECARRALEQLNGFELAGRPMRVGHVTERLDGGTDITFPDGDQELDLGSAGGRFQLMAKLAEGAGIQLPSTAAAAAAAAAQAAALQLNGAVPLGALNPAALTALSPALNLASQCFQLSSLFTPQTM

SEQ ID NO: 75230 - protein, 191 aa, Homo sapiens
  Payload ID: 14868
  Gene Symbol: RBM24
  Gene Name: RNA binding motif protein 24
  Uniprot ID: Q9BX46
  ENSP ID: ENSP00000319551
MYVCLCVSVAKVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 75231 - protein, 236 aa, Homo sapiens
  Payload ID: 14868
  Gene Symbol: RBM24
  Gene Name: RNA binding motif protein 24
  Uniprot ID: Q9BX46
  ENSP ID: ENSP00000368341
MHTTQKDTTYTKIFVGGLPYHTTDASLRKYFEVFGEIEEAVVITDRQTGKSRGYGFVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 75232 - protein, 178 aa, Homo sapiens
  Payload ID: 14868
  Gene Symbol: RBM24
  Gene Name: RNA binding motif protein 24
  Uniprot ID: Q9BX46
  ENSP ID: ENSP00000396898
MADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 75233 - protein, 201 aa, Homo sapiens
  Payload ID: 14868
  Gene Symbol: RBM24
  Gene Name: RNA binding motif protein 24
  ENSP ID: ENSP00000421971
  MOD_RES (1)..(1): Any amino acid
XSRTIAIVVGECFRGWERWADVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 75234 - protein, 80 aa, Homo sapiens
  Payload ID: 14868
  Gene Symbol: RBM24
  Gene Name: RNA binding motif protein 24
  ENSP ID: ENSP00000426222
VITDRQTGKSRGYGFVTMADRAAAERACKDPNPIIDGRKANVNLAYLGAKPRIMQPGFAFGVQQLHPALIQRPFGDKQAG

SEQ ID NO: 75235 - protein, 843 aa, Homo sapiens
  Payload ID: 14869
  Gene Symbol: RBM25
  Gene Name: RNA binding motif protein 25
  Uniprot ID: P49756
  ENSP ID: ENSP00000261973
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKKLEEEKGKKEKERQEIEKERRERERERERERERREREREREREREREKEKERERERERDRDRDRTKERDRDRDRERDRDRDRERSSDRNKDRSRSREKSRDREREREREREREREREREREREREREREREREREREKDKKRDREEDEEDAYERRKLERKLREKEAAYQERLKNWEIRERKKTREYEKEAEREEERRREMAKEAKRLKEFLEDYDDDRDDPKYYRGSALQKRLRDREKEMEADERDRKREKEELEEIRQRLLAEGHPDPDAELQRMEQEAERRRQPQIKQEPESEEEEEEKQEKEEKREEPMEEEEEPEQKPCLKPTLRPISSAPSVSSASGNATPNTPGDESPCGIIIPHENSPDQQQPEEHRPKIGLSLKLGASNSPGQPNSVKRKKLPVDSVFNKFEDEDSDDVPRKRKLVPLDYGEDDKNATKGTVNTEEKRKHIKSLIEKIPTAKPELFAYPLDWSIVDSILMERRIRPWINKKIIEYIGEEEATLVDFVCSKVMAHSSPQSILDDVAMVLDEEAEVFIVKMWRLLIYETEAKKIGLVK

SEQ ID NO: 75236 - protein, 843 aa, Homo sapiens; identical to SEQ ID NO: 75235
  Payload ID: 14869
  Gene Symbol: RBM25
  Gene Name: RNA binding motif protein 25
  Uniprot ID: P49756
  ENSP ID: ENSP00000431150

SEQ ID NO: 75237 - protein, 127 aa, Homo sapiens
  Payload ID: 14869
  Gene Symbol: RBM25
  Gene Name: RNA binding motif protein 25
  ENSP ID: ENSP00000434004
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQ

SEQ ID NO: 75238 - protein, 243 aa, Homo sapiens
  Payload ID: 14869
  Gene Symbol: RBM25
  Gene Name: RNA binding motif protein 25
  ENSP ID: ENSP00000434333
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKED

SEQ ID NO: 75239 - protein, 164 aa, Homo sapiens
  Payload ID: 14869
  Gene Symbol: RBM25
  Gene Name: RNA binding motif protein 25
  Uniprot ID: P49756
  ENSP ID: ENSP00000434444
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAPSDSVSTRSQNLPSVHSDYYMTCKLERKSYSLKLMQRQRHSWMNGKQRRKLLMGLG

SEQ ID NO: 75240 - protein, 73 aa, Homo sapiens
  Payload ID: 14869
  Gene Symbol: RBM25
  Gene Name: RNA binding motif protein 25
  ENSP ID: ENSP00000434950
  MOD_RES (1)..(1): Any amino acid
XNAPSQESDSHPRKKKKEKKEDIFRRFPVAPLIPYPLITKEDINAIEMEEDKRDLISREISKFRDTHKRSYGD

SEQ ID NO: 75241 - protein, 294 aa, Homo sapiens
  Payload ID: 14869
  Gene Symbol: RBM25
  Gene Name: RNA binding motif protein 25
  Uniprot ID: P49756
  ENSP ID: ENSP00000436225
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKRSYGD

SEQ ID NO: 75242 - protein, 300 aa, Homo sapiens
  Payload ID: 14869
  Gene Symbol: RBM25
  Gene Name: RNA binding motif protein 25
  Uniprot ID: P49756
  ENSP ID: ENSP00000436868
MSFPPHLNRPPMGIPALPPGIPPPQFPGFPPPVPPGTPMIPVPMSIMAPAPTVLVPTVSMVGKHLGARKDHPGLKAKENDENCGPTTTVFVGNISEKASDMLIRQLLAKCGLVLSWKRVQGASGKLQAFGFCEYKEPESTLRALRLLHDLQIGEKKLLVKVDAKTKAQLDEWKAKKKASNGNARPETVTNDDEEALDEETKRRDQMIKGAIEVLIREYSSELNAPSQESDSHPRKKKKEKKEDIFRRFPVAPLIPYPLITKEDINAIEMEEDKRDLISREISKFRDTHKVVFLSFHLIPI

SEQ ID NO: 75243 - protein, 980 aa, Homo sapiens
  Payload ID: 14870
  Gene Symbol: RBM26
  Gene Name: RNA binding motif protein 26
  Uniprot ID: Q5T8P6
  ENSP ID: ENSP00000267229
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 75244 - protein, 1007 aa, Homo sapiens
  Payload ID: 14870
  Gene Symbol: RBM26
  Gene Name: RNA binding motif protein 26
  Uniprot ID: Q5T8P6
  ENSP ID: ENSP00000387531
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKVMQPLVQQPILPVVKQSVKERLGPVPSSTIEPAEAQSASSDLPQNVTKLSVKDRLGFVSKPSVSATEKVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 75245 - protein, 983 aa, Homo sapiens
  Payload ID: 14870
  Gene Symbol: RBM26
  Gene Name: RNA binding motif protein 26
  Uniprot ID: Q5T8P6
  ENSP ID: ENSP00000390222
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTADTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKVMQPLVQQPILPVVKQSVKERLGPVPSSTIEPAEAQSASSDLPQVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 75246 - protein, 171 aa, Homo sapiens
  Payload ID: 14870
  Gene Symbol: RBM26
  Gene Name: RNA binding motif protein 26
  ENSP ID: ENSP00000401474
LDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEQREIIIA

SEQ ID NO: 75247 - protein, 1009 aa, Homo sapiens
  Payload ID: 14870
  Gene Symbol: RBM26
  Gene Name: RNA binding motif protein 26
  ENSP ID: ENSP00000483408
MVSKMIIENFEALKSWLSKTLEPICDADPSALAKYVLALVKKDKSEKELKALCIDQLDVFLQKETQIFVEKLFDAVNTKSYLPPPEQPSSGSLKVEFFPHQEKDIKKEEITKEEEREKKFSRRLNHSPPQSSSRYRENRSRDERKKDDRSRKRDYDRNPPRRDSYRDRYNRRRGRSRSYSRSRSRSWSKERLRERDRDRSRTRSRSRTRSRERDLVKPKYDLDRTDPLENNYTPVSSVPSISSGHYPVPTLSSTITVIAPTHHGNNTTESWSEFHEDQVDHNSYVRPPMPKKRCRDYDEKGFCMRGDMCPFDHGSDPVVVEDVNLPGMLPFPAQPPVVEGPPPPGLPPPPPILTPPPVNLRPPVPPPGPLPPSLPPVTGPPPPLPPLQPSGMDAPPNSATSSVPTVVTTGIHHQPPPAPPSLFTAVFVLPDTYDTDGYNPEAPSITNTSRPMYRHRVHAQRPNLIGLTSGDMDLPPREKPPNKSSMRIVVDSESRKRTIGSGEPGVPTKKTWFDKPNFNRTNSPGFQKKVQFGNENTKLELRKVPPELNNISKLNEHFSRFGTLVNLQVAYNGDPEGALIQFATYEEAKKAISSTEAVLNNRFIKVYWHREGSTQQLQTTSPKPLVQQPILPVVKQSVKERLGPVPSSTIEPAEAQSASSDLPQNVTKLSVKDRLGFVSKPSVSATEKVLSTSTGLTKTVYNPAALKAAQKTLLVSTSAVDNNEAQKKKQEALKLQQDVRKRKQEILEKHIETQKMLISKLEKNKTMKSEDKAEIMKTLEVLTKNITKLKDEVKAASPGRCLPKSIKTKTQMQKELLDTELDLYKKMQAGEEVTELRRKYTELQLEAAKRGILSSGRGRGIHSRGRGAVHGRGRGRGRGRGVPGHAVVDHRPRALEISAFTESDREDLLPHFAQYGEIEDCQIDDSSLHAVITFKTRAEAEAAAVHGARFKGQDLKLAWNKPVTNISAVETEEVEPDEEEFQEESLVDDSLLQDDDEEEEDNESRSWRR

SEQ ID NO: 75248 - protein, 1060 aa, Homo sapiens
  Payload ID: 14871
  Gene Symbol: RBM27
  Gene Name: RNA binding motif protein 27
  Uniprot ID: Q9P2N5
  ENSP ID: ENSP00000265271
MLIEDVDALKSWLAKLLEPICDADPSALANYVVALVKKDKPEKELKAFCADQLDVFLQKETSGFVDKLFESLYTKNYLPLLEPVKPEPKPLVQEKEEIKEEVFQEPAEEERDGRKKKYPSPQKTRSESSERRTREKKREDGKWRDYDRYYERNELYREKYDWRRGRSKSRSKSRGLSRSRSRSRGRSKDRDPNRNVEHRERSKFKSERNDLESSYVPVSAPPPNSSEQYSSGAQSIPSTVTVIAPAHHSENTTESWSNYYNNHSSSNSFGRNLPPKRRCRDYDERGFCVLGDLCQFDHGNDPLVVDEVALPSMIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSERQPMYSREHGAAASERLQLGTPPPLLAARLVPPRNLMGSSIGYHTSVSSPTPLVPDTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQVAFKGDPEAALIQYLTNEEARKAISSTEAVLNNRFIRVLWHRENNEQPTLQSSAQLLLQQQQTLSHLSQQHHHLPQHLHQQQVLVAQSAPSTVHGGIQKMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSTANQGPKFKDRRLQISWHKPKVPSISTETEEEEVKEEETETSDLFLPDDDDEDEDEYESRSWRR

SEQ ID NO: 75249 - protein, 759 aa, Homo sapiens
  Payload ID: 14872
  Gene Symbol: RBM28
  Gene Name: RNA binding motif protein 28
  Uniprot ID: Q9NW13
  ENSP ID: ENSP00000223073
MAGLTLFVGRLPPSARSEQLEELFSQVGPVKQCFVVTEKGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPDGKMRGFGFVQFKNLLEAGKALKGMNMKEIKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKQKLLGPSKGAPLAKRSKWFDS

SEQ ID NO: 75250 - protein, 618 aa, Homo sapiens
  Payload ID: 14872
  Gene Symbol: RBM28
  Gene Name: RNA binding motif protein 28
  Uniprot ID: Q9NW13
  ENSP ID: ENSP00000390517
MAGLTLFVGRLPPSARSEQLEELFSQVGPVKQCFVVTEKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKQKLLGPSKGAPLAKRSKWFDS

SEQ ID NO: 75251 - protein, 283 aa, Homo sapiens
  Payload ID: 14872
  Gene Symbol: RBM28
  Gene Name: RNA binding motif protein 28
  ENSP ID: ENSP00000418071
MAGLTLFVGRLPPSARSEQLEELFSQVGPVKQCFVVTEKGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQED

SEQ ID NO: 75252 - protein, 186 aa, Homo sapiens
  Payload ID: 14872
  Gene Symbol: RBM28
  Gene Name: RNA binding motif protein 28
  ENSP ID: ENSP00000419840
  MOD_RES (1)..(1): Any amino acid
XKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGWWA

SEQ ID NO: 75253 - protein, 204 aa, Homo sapiens
  Payload ID: 14872
  Gene Symbol: RBM28
  Gene Name: RNA binding motif protein 28
  ENSP ID: ENSP00000420503
MAGLTLFVGRLPPSARSEQLEELFSQVGPVKQCFVVTEKVYVDQCPVSKGLYPEGDSNAVEREAEHMNYVSFSGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPDGKMRGFGFVQFKNLLEAGKA

SEQ ID NO: 75254 - protein, 268 aa, Homo sapiens
  Payload ID: 14873
  Gene Symbol: RBM33
  Gene Name: RNA binding motif protein 33
  Uniprot ID: Q96EV2
  ENSP ID: ENSP00000287912
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLGNFFACLPSSFTLISTSSIVLL

SEQ ID NO: 75255 - protein, 284 aa, Homo sapiens
  Payload ID: 14873
  Gene Symbol: RBM33
  Gene Name: RNA binding motif protein 33
  ENSP ID: ENSP00000303878
DLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAALLEFEERERQHKQGRYSSRRGGRRGGPLMCRGVGDQRRESTERGRMKDHRPALLPTQPPVVILPEEELMSDLMP

SEQ ID NO: 75256 - protein, 106 aa, Homo sapiens
  Payload ID: 14873
  Gene Symbol: RBM33
  Gene Name: RNA binding motif protein 33
  ENSP ID: ENSP00000341583
MHGRGRGVAGPMGRGRLMPNKQNLRVVECKPQPCVVSVEGLSSSTTDAQLKSLLMSVGPIQSLQMLPQQRKAIAKFKEPAHALAFQQKFHRHMIDLSHINVALIVE

SEQ ID NO: 75257 - protein, 84 aa, Homo sapiens
  Payload ID: 14873
  Gene Symbol: RBM33
  Gene Name: RNA binding motif protein 33
  ENSP ID: ENSP00000376510
  MOD_RES (1)..(1): Any amino acid
XCKPQPCVVSVEGLSSSTTDAQLKSLLMSVGPIQSLQMLPQQRKAIAKFKEPAHALAFQQKFHRELPAGAEPPGAQVSPGRCPA

SEQ ID NO: 75258 - protein, 308 aa, Homo sapiens
  Payload ID: 14873
  Gene Symbol: RBM33
  Gene Name: RNA binding motif protein 33
  ENSP ID: ENSP00000376513
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTDEEYLQAYGGQQGLQEQEDCVAEDELDEITDAQVAPATEEGGMETLELQKDIKEESDEEEEDDEESGRLRFKTERKEGTIIRLSDVTRERRNIPETLGNFFACLPSSFTLISTSSIVLL

SEQ ID NO: 75259 - protein, 909 aa, Homo sapiens
  Payload ID: 14873
  Gene Symbol: RBM33
  Gene Name: RNA binding motif protein 33
  ENSP ID: ENSP00000376514
  MOD_RES (1)..(1): Any amino acid
XIRLSDVTRERRNIPETLELSAEAKAALLEFEERERQHKQGRYSSRRGGRRGGPLMCRGVGDQRRESTERGRMKDHRPALLPTQPPVVPQAPPPPPPPPQQQPIRSLFQPQPLQPLLPVQHPHHPSPPQGMHMPPQLETPRMMMTPPPVTPQQPKNIHINPHFKGTVVTPVQVPLLPVPSQPRPAVGPQRFPGPPEFPQHTPGPVPNSFSQPPRLPLQDQWRAPPPPQDRDPFFLGVSGEPRFPSHLFLEQRSPPPPPPPPTLLNSSHPVPTQSPLPFTQPGPAFNQQGQQPVFPRERPVRPALQPPGPVGILHFSQPGSATTRPFIPPRQPFLPGPGQPFLPTHTQPNLQGPLHPPLPPPHQPQPQQPQQQPPPQHQPPHQPPHQPPPQHQPPPQHPPQHPPQHQHHHHHHHLSVPPPPLMPMSQPQFRPHVQTAQPQASSSRMQCPQRQGLRHNTTSQNVSKRPMQQMQPTAPRNSNLRELPIAPSHVIEMSSSRCSATPSAQVKPIVSASPPSRAVAGSRSSQGKTEVKVKPASPVAQPKEEAKTETEFPDEDEETRLYRLKIEEQKRLREEILKQKELRRQQQAGARKKELLERLAQQQQQLYAPPPPAEQEEQALSPSPTNGNPLLPFPGAQVRQNVKNRLLVKNQDVSISNVQPKTSNFVPSSANMQYQGQQMKALKHLRQTRTVPQSQTQPLHKVLPIKPADVEEPAVPQTPRVASIQGRPQDTKPGVKRTVTHRTNSGGGDGPHISSKVRVIKLSGGQGGESDGFFHPEGQPQRLPQPPEVGPQPARKVTLTRGGLQQPPHLPAGPHAHSPVPPGIKSIQGIHPAKKAIMHGRGRGVAGPMGRGRLMPNKQNLRVVECKPQPCVVSVEGLSSSTTDAQLKSLLMSVGPIQVAAWGWHLCHG

SEQ ID NO: 75260 - protein, 1170 aa, Homo sapiens
  Payload ID: 14873
  Gene Symbol: RBM33
  Gene Name: RNA binding motif protein 33
  Uniprot ID: Q96EV2
  ENSP ID: ENSP00000384160
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAALLEFEERERQHKQGRYSSRRGGRRGGPLMCRGVGDQRRESTERGRMKDHRPALLPTQPPVVPQAPPPPPPPPQQQPIRSLFQPQPLQPLLPVQHPHHPSPPQGMHMPPQLETPRMMMTPPPVTPQQPKNIHINPHFKGTVVTPVQVPLLPVPSQPRPAVGPQRFPGPPEFPQHTPGPVPNSFSQPPRLPLQDQWRAPPPPQDRDPFFLGVSGEPRFPSHLFLEQRSPPPPPPPPTLLNSSHPVPTQSPLPFTQPGPAFNQQGQQPVFPRERPVRPALQPPGPVGILHFSQPGSATTRPFIPPRQPFLPGPGQPFLPTHTQPNLQGPLHPPLPPPHQPQPQQPQQQPPPQHQPPHQPPHQPPPQHQPPPQHPPQHPPQHQHHHHHHHLSVPPPPLMPMSQPQFRPHVQTAQPQASSSRMQCPQRQGLRHNTTSQNVSKRPMQQMQPTAPRNSNLRELPIAPSHVIEMSSSRCSATPSAQVKPIVSASPPSRAVAGSRSSQGKTEVKVKPASPVAQPKEEAKTETEFPDEDEETRLYRLKIEEQKRLREEILKQKELRRQQQAGARKKELLERLAQQQQQLYAPPPPAEQEEQALSPSPTNGNPLLPFPGAQVRQNVKNRLLVKNQDVSISNVQPKTSNFVPSSANMQYQGQQMKALKHLRQTRTVPQSQTQPLHKVLPIKPADVEEPAVPQTPRVASIQGRPQDTKPGVKRTVTHRTNSGGGDGPHISSKVRVIKLSGGGGESDGFFHPEGQPQRLPQPPEVGPQPARKVTLTRGGLQQPPHLPAGPHAHSPVPPGIKSIQGIHPAKKAIMHGRGRGVAGPMGRGRLMPNKQNLRVVECKPQPCVVSVEGLSSSTTDAQLKSLLMSVGPIQSLQMLPQQRKAIAKFKEPAHALAFQQKFHRHMIDLSHINVALIVE

SEQ ID NO: 75261 - protein, 342 aa, Homo sapiens
  Payload ID: 14873
  Gene Symbol: RBM33
  Gene Name: RNA binding motif protein 33
  ENSP ID: ENSP00000394987
QSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAALLEFEERERQHKQGRYSSRRGGRRGGPLMCRGVGDQRRESTERGRMKDHRPALLPTQPPVVTHSPRLIPPQPQAPPPPPPPPQQQPIRSLFQPQPLQPLLPVQHPHHPSPPQGMHMPPQLETPRMMMTPPPVTPQQPKNIHINPHFKGTVVTPVQVPLLPVPSQPRPAVGPQRFPGPPEFPQHTPGPVPNSFSQPP

SEQ ID NO: 75262 - protein, 28 aa, Homo sapiens
  Payload ID: 14873
  Gene Symbol: RBM33
  Gene Name: RNA binding motif protein 33
  ENSP ID: ENSP00000405793
MHGRGRGVAGPMGRGRLMPNKQNLRVVE

SEQ ID NO: 75263 - protein, 430 aa, Homo sapiens
  Payload ID: 14874
  Gene Symbol: RBM34
  Gene Name: RNA binding motif protein 34
  Uniprot ID: P42696
  ENSP ID: ENSP00000386226
MALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 75264 - protein, 408 aa, Homo sapiens
  Payload ID: 14874
  Gene Symbol: RBM34
  Gene Name: RNA binding motif protein 34
  ENSP ID: ENSP00000400000
LEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 75265 - protein, 211 aa, Homo sapiens
  Payload ID: 14874
  Gene Symbol: RBM34
  Gene Name: RNA binding motif protein 34
  ENSP ID: ENSP00000413409
MALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADSSPFRLMLRPCLSISSNTLYCIYRFTIYFWESALASADLEEEIHQKQGQKRKNSQPGVKVADRKILDDTEDTVVSQRKKIQINQEEERLK

SEQ ID NO: 75266 - protein, 86 aa, Homo sapiens
  Payload ID: 14874
  Gene Symbol: RBM34
  Gene Name: RNA binding motif protein 34
  ENSP ID: ENSP00000420236
  MOD_RES (1)..(1): Any amino acid
XVRMALEGMSKRKRKRSVQEGENPDDGVRGSPPEDYRLGQVASSLFRGEHHSRGGTGRLASLFSSLEPQIQPVYVPVPKGKRSSEC

SEQ ID NO: 75267 - protein, 77 aa, Homo sapiens
  Payload ID: 14875
  Gene Symbol: RBM38
  Gene Name: RNA binding motif protein 38
  ENSP ID: ENSP00000343718
MLLQPAPCAPSAGFPRPLAAPGAMHGSQKDTTFTKIFVGGLPYHTTDASLRKYFEGFGDIEEAVVITDRQTGDYFCP

SEQ ID NO: 75268 - protein, 123 aa, Homo sapiens
  Payload ID: 14875
  Gene Symbol: RBM38
  Gene Name: RNA binding motif protein 38
  ENSP ID: ENSP00000345248
MHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTGFAIGVQQLHPTLIQRTYGGDFMFRK

SEQ ID NO: 75269 - protein, 239 aa, Homo sapiens
  Payload ID: 14875
  Gene Symbol: RBM38
  Gene Name: RNA binding motif protein 38
  Uniprot ID: Q9H0Z9
  ENSP ID: ENSP00000348538
MLLQPAPCAPSAGFPRPLAAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 75270 - protein, 158 aa, Homo sapiens
  Payload ID: 14875
  Gene Symbol: RBM38
  Gene Name: RNA binding motif protein 38
  ENSP ID: ENSP00000360263
MADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 75271 - protein, 121 aa, Homo sapiens
  Payload ID: 14875
  Gene Symbol: RBM38
  Gene Name: RNA binding motif protein 38
  Uniprot ID: Q9H0Z9
  ENSP ID: ENSP00000407848
MLLQPAPCAPSAGFPRPLAAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTG

SEQ ID NO: 75272 - protein, 530 aa, Homo sapiens
  Payload ID: 14876
  Gene Symbol: RBM39
  Gene Name: RNA binding motif protein 39
  Uniprot ID: Q14498
  ENSP ID: ENSP00000253363
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 75273 - protein, 423 aa, Homo sapiens
  Payload ID: 14876
  Gene Symbol: RBM39
  Gene Name: RNA binding motif protein 39
  ENSP ID: ENSP00000344581
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEALFVIMFWNEIWSDNMITLQL

SEQ ID NO: 75274 - protein, 524 aa, Homo sapiens
  Payload ID: 14876
  Gene Symbol: RBM39
  Gene Name: RNA binding motif protein 39
  Uniprot ID: Q14498
  ENSP ID: ENSP00000354437
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 75275 - protein, 231 aa, Homo sapiens
  Payload ID: 14876
  Gene Symbol: RBM39
  Gene Name: RNA binding motif protein 39
  ENSP ID: ENSP00000363150
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEK

SEQ ID NO: 75276 - protein, 95 aa, Homo sapiens
  Payload ID: 14876
  Gene Symbol: RBM39
  Gene Name: RNA binding motif protein 39
  ENSP ID: ENSP00000380527
MADDIDIEAMLEAPYKKDENKLSSANGHEERSKKILCIKNLDLLTWKRSNPVIAKHLYCRGHITKKSKGPAQWTIYFSDVQYKISLPLKTLESPF

SEQ ID NO: 75277 - protein, 40 aa, Homo sapiens
  Payload ID: 14876
  Gene Symbol: RBM39
  Gene Name: RNA binding motif protein 39
  ENSP ID: ENSP00000385977
MADDIDIEAMLEAPYKKTCLTISHLYSHEFTFDSSVNCQS

SEQ ID NO: 75278 - protein, 23 aa, Homo sapiens
  Payload ID: 14876
  Gene Symbol: RBM39
  Gene Name: RNA binding motif protein 39
  ENSP ID: ENSP00000389459
TCLTISHLYSHEFTFDSSVNCQS

SEQ ID NO: 75279 - protein, 40 aa, Homo sapiens; identical to SEQ ID NO: 75277
  Payload ID: 14876
  Gene Symbol: RBM39
  Gene Name: RNA binding motif protein 39
  ENSP ID: ENSP00000390303

SEQ ID NO: 75280 - protein, 193 aa, Homo sapiens
  Payload ID: 14876
  Gene Symbol: RBM39
  Gene Name: RNA binding motif protein 39
  ENSP ID: ENSP00000393493
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRS

SEQ ID NO: 75281 - protein, 40 aa, Homo sapiens; identical to SEQ ID NO: 75277
  Payload ID: 14876
  Gene Symbol: RBM39
  Gene Name: RNA binding motif protein 39
  ENSP ID: ENSP00000394602

SEQ ID NO: 75282 - protein, 336 aa, Homo sapiens
  Payload ID: 14876
  Gene Symbol: RBM39
  Gene Name: RNA binding motif protein 39
  ENSP ID: ENSP00000394824
  MOD_RES (1)..(1): Any amino acid
XSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAI

SEQ ID NO: 75283 - protein, 47 aa, Homo sapiens
  Payload ID: 14876
  Gene Symbol: RBM39
  Gene Name: RNA binding motif protein 39
  ENSP ID: ENSP00000395124
MADDIDIEAMLEAPYKKDENKLSSANGHEERSKKQTFCLLGKLYISL

SEQ ID NO: 75284 - protein, 40 aa, Homo sapiens; identical to SEQ ID NO: 75277
  Payload ID: 14876
  Gene Symbol: RBM39
  Gene Name: RNA binding motif protein 39
  ENSP ID: ENSP00000395563

SEQ ID NO: 75285 - protein, 40 aa, Homo sapiens; identical to SEQ ID NO: 75277
  Payload ID: 14876
  Gene Symbol: RBM39
  Gene Name: RNA binding motif protein 39
  ENSP ID: ENSP00000397443

SEQ ID NO: 75286 - protein, 40 aa, Homo sapiens; identical to SEQ ID NO: 75277
  Payload ID: 14876
  Gene Symbol: RBM39
  Gene Name: RNA binding motif protein 39
  ENSP ID: ENSP00000397917

SEQ ID NO: 75287 - protein, 86 aa, Homo sapiens
  Payload ID: 14876
  Gene Symbol: RBM39
  Gene Name: RNA binding motif protein 39
  ENSP ID: ENSP00000405916
  MOD_RES (1)..(1): Any amino acid
XPYKKDENKLSSANGHEERSKKRKKSKSRSRSHERKRSKSKERKRSRDRERKKSKSRERKRSRSKERRRSRSRSRDRRFRGRYRSP

SEQ ID NO: 75288 - protein, 40 aa, Homo sapiens; identical to SEQ ID NO: 75277
  Payload ID: 14876
  Gene Symbol: RBM39
  Gene Name: RNA binding motif protein 39
  ENSP ID: ENSP00000406900

SEQ ID NO: 75289 - protein, 62 aa, Homo sapiens
  Payload ID: 14876
  Gene Symbol: RBM39
  Gene Name: RNA binding motif protein 39
  ENSP ID: ENSP00000407150
MADDIDIEAMLEAPYKKGEMCDRGGIKLLQSQPSNGNGRRSQEWHRSQEIDSGWLLAWPLGA

SEQ ID NO: 75290 - protein, 39 aa, Homo sapiens
  Payload ID: 14876
  Gene Symbol: RBM39
  Gene Name: RNA binding motif protein 39
  ENSP ID: ENSP00000407466
MADDIDIEAMLEAPYKKDENKLSSANGHEERSKKSLNAS

SEQ ID NO: 75291 - protein, 508 aa, Homo sapiens
  Payload ID: 14876
  Gene Symbol: RBM39
  Gene Name: RNA binding motif protein 39
  Uniprot ID: Q14498
  ENSP ID: ENSP00000436747
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 75292 - protein, 59 aa, Homo sapiens
  Payload ID: 14876
  Gene Symbol: RBM39
  Gene Name: RNA binding motif protein 39
  ENSP ID: ENSP00000483837
LERTGIDLGTTGRLQLMARLAEGTGLQIPPAAQQALQMSGSLAFGAVAVEALHCSCTEL

SEQ ID NO: 75293 - protein, 245 aa, Homo sapiens
  Payload ID: 14876
  Gene Symbol: RBM39
  Gene Name: RNA binding motif protein 39
  ENSP ID: ENSP00000489005
TVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGSGSVAQFGVQLCDPGSPQPLPLWLKPSSHPNL

SEQ ID NO: 75294 - protein, 163 aa, Homo sapiens
  Payload ID: 14876
  Gene Symbol: RBM39
  Gene Name: RNA binding motif protein 39
  ENSP ID: ENSP00000489196
  MOD_RES (1)..(1): Any amino acid
XQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAGKKRQILLLFKVY

SEQ ID NO: 75295 - protein, 364 aa, Homo sapiens
  Payload ID: 14877
  Gene Symbol: RBM4
  Gene Name: RNA binding motif protein 4
  Uniprot ID: Q9BWF3
  ENSP ID: ENSP00000309166
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 75296 - protein, 143 aa, Homo sapiens
  Payload ID: 14877
  Gene Symbol: RBM4
  Gene Name: RNA binding motif protein 4
  Uniprot ID: Q9BWF3
  ENSP ID: ENSP00000381680
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGGMCVG

SEQ ID NO: 75297 - protein, 364 aa, Homo sapiens; identical to SEQ ID NO: 75295
  Payload ID: 14877
  Gene Symbol: RBM4
  Gene Name: RNA binding motif protein 4
  Uniprot ID: Q9BWF3
  ENSP ID: ENSP00000386561

SEQ ID NO: 75298 - protein, 364 aa, Homo sapiens; identical to SEQ ID NO: 75295
  Payload ID: 14877
  Gene Symbol: RBM4
  Gene Name: RNA binding motif protein 4
  Uniprot ID: Q9BWF3
  ENSP ID: ENSP00000386894

SEQ ID NO: 75299 - protein, 173 aa, Homo sapiens
  Payload ID: 14877
  Gene Symbol: RBM4
  Gene Name: RNA binding motif protein 4
  Uniprot ID: Q9BWF3
  ENSP ID: ENSP00000413497
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKITPVTEGYCCCNKGHTYIFKNCNLILESRKSRRC

SEQ ID NO: 75300 - protein, 240 aa, Homo sapiens
  Payload ID: 14877
  Gene Symbol: RBM4
  Gene Name: RNA binding motif protein 4
  ENSP ID: ENSP00000422301
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGKRMHVQLSTSRLRTAPGMGDQSGCYRHLLPTSGAAATAAAAAAAAAAVTAASTSYYGRDRSPLRRATAPVPTVGEGYGYGHESELSQASAAARNSLYDMARY

SEQ ID NO: 75301 - protein, 150 aa, Homo sapiens
  Payload ID: 14877
  Gene Symbol: RBM4
  Gene Name: RNA binding motif protein 4
  ENSP ID: ENSP00000423572
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQDIQLCHPSCSVVA

SEQ ID NO: 75302 - protein, 177 aa, Homo sapiens
  Payload ID: 14877
  Gene Symbol: RBM4
  Gene Name: RNA binding motif protein 4
  Uniprot ID: Q9BWF3
  ENSP ID: ENSP00000432020
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQGEPPSLGRGLNTRLCAENGWISKRRGLVKITAVGWLVMKK

SEQ ID NO: 75303 - protein, 143 aa, Homo sapiens; identical to SEQ ID NO: 75296
  Payload ID: 14877
  Gene Symbol: RBM4
  Gene Name: RNA binding motif protein 4
  Uniprot ID: Q9BWF3
  ENSP ID: ENSP00000432150

SEQ ID NO: 75304 - protein, 177 aa, Homo sapiens; identical to SEQ ID NO: 75302
  Payload ID: 14877
  Gene Symbol: RBM4
  Gene Name: RNA binding motif protein 4
  Uniprot ID: Q9BWF3
  ENSP ID: ENSP00000435821

SEQ ID NO: 75305 - protein, 155 aa, Homo sapiens
  Payload ID: 14877
  Gene Symbol: RBM4
  Gene Name: RNA binding motif protein 4
  ENSP ID: ENSP00000464349
MVKLFIGNLPREATEQEIRSLFEQYGKVLECDIIKNYGFVHIEDKTAAEDAIRNLHHYKLHGVNINVEASKNKSKTSTKLHVGNISPTCTNKELRAKFEEYGPVIECDIVKDYAFVHMERAEDAVEAIRGLDNTEFQVETGFHRVNQDGLDLLTS

SEQ ID NO: 75306 - protein, 413 aa, Homo sapiens
  Payload ID: 14878
  Gene Symbol: RBM41
  Gene Name: RNA binding motif protein 41
  Uniprot ID: Q96IZ5
  ENSP ID: ENSP00000361557
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATGSTTEISGS

SEQ ID NO: 75307 - protein, 405 aa, Homo sapiens
  Payload ID: 14878
  Gene Symbol: RBM41
  Gene Name: RNA binding motif protein 41
  Uniprot ID: Q96IZ5
  ENSP ID: ENSP00000361565
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQDEPQKKNKGDPMNNLESFYQEMIMKKRLEEFQLMRGEPFASHSLVSATSVGDSGTAESPSLLQDKGKQAAQGKGPSLHVANVIDFSPEQCWTGPKKLTQPIEFVPEDEIQRNRLSEEEIRKIPMFSSYNPGEPNKVLYLKNLSPRVTERDLVSLFARFQEKKGPPIQFRMMTGRMRGQAFITFPNKEIAWQALHLVNGYKLHGKILVIEFGKNKKQRSNLQATSLISCATG

SEQ ID NO: 75308 - protein, 203 aa, Homo sapiens
  Payload ID: 14878
  Gene Symbol: RBM41
  Gene Name: RNA binding motif protein 41
  ENSP ID: ENSP00000405522
  MOD_RES (1)..(1): Any amino acid
XVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKGIIPEEP

SEQ ID NO: 75309 - protein, 311 aa, Homo sapiens
  Payload ID: 14878
  Gene Symbol: RBM41
  Gene Name: RNA binding motif protein 41
  Uniprot ID: Q96IZ5
  ENSP ID: ENSP00000433251
MKRVNSCVKSDEHVLEELETEGERQLKSLLQHQLDTSVSIEECMSKKESFAPGTMYKPFGKEAAGTMTLSQFQTLHEKDQETASLRELGLNETEILIWKSHVSGEKKTKLRATPEAIQNRLQDIEERISERQRILCLPQRFAKSKQLTRREMEIEKSLFQGADRHSFLKALYYQAYHKKTSADKYMTSMKRKIKLGTKDEPQKKNKGDPMNNLESFYQEMIMKKRLEEFQLMRGLTSFPREDFQNLSYEGTTSVLGAKWQKRTGRTSTFSILLVSLLSETVFTSSAMYGIPHLLTMSLKFSTRIGKLSFTP

SEQ ID NO: 75310 - protein, 480 aa, Homo sapiens
  Payload ID: 14879
  Gene Symbol: RBM42
  Gene Name: RNA binding motif protein 42
  Uniprot ID: Q9BTD8
  ENSP ID: ENSP00000262633
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRAAVAPQRAPILRPAFVPHVLQRADSALSSAAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 75311 - protein, 450 aa, Homo sapiens
  Payload ID: 14879
  Gene Symbol: RBM42
  Gene Name: RNA binding motif protein 42
  Uniprot ID: Q9BTD8
  ENSP ID: ENSP00000466044
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 75312 - protein, 184 aa, Homo sapiens
  Payload ID: 14879
  Gene Symbol: RBM42
  Gene Name: RNA binding motif protein 42
  ENSP ID: ENSP00000466548
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMAKVIRDKRTGKTKGYGFVSFKDPSDYVRAMREMNGKYVGSRPIKLRKSMWKDRNLDVVRKKQKEKKKLGLR

SEQ ID NO: 75313 - protein, 458 aa, Homo sapiens
  Payload ID: 14879
  Gene Symbol: RBM42
  Gene Name: RNA binding motif protein 42
  ENSP ID: ENSP00000467278
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRADSALSSAAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 75314 - protein, 426 aa, Homo sapiens
  Payload ID: 14879
  Gene Symbol: RBM42
  Gene Name: RNA binding motif protein 42
  ENSP ID: ENSP00000467614
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDADDFRIFCGDLGNEVNDDILARAFSRFPSFLKAKVIRDKRTGKTKGYGFVSFKDPSDYVRAMREMNGKYVGSRPIKLRKSMWKDRNLDVVRKKQKEKKKLGLR

SEQ ID NO: 75315 - protein, 386 aa, Homo sapiens
  Payload ID: 14879
  Gene Symbol: RBM42
  Gene Name: RNA binding motif protein 42
  ENSP ID: ENSP00000468060
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARAAAAATVVPPMVGGPPFVGPVGFGPGDRSHLDSPEAREAMFLRRAAAGPRPMALRPPHQALVGPPLPGPPGPPMMLPPMARAPGPPLGSMAALRPPLEEPAAPRELGLGLGLGLKEKEEAVVAAAAGLEEASAAVAVGAGGAPAGPAVIGPSLPLALAMPLPEPEPLPLPLEVVRGLLPPLRIPELLSLRPRPRPPRPEPPPGLMALEVPEPLGEDKKKGKPEKLKRCIRTAAGSSWEDPSLLEWDAGKYVGSRPIKLRKSMWKDRNLDVVRKKQKEKKKLGLR

SEQ ID NO: 75316 - protein, 357 aa, Homo sapiens
  Payload ID: 14880
  Gene Symbol: RBM43
  Gene Name: RNA binding motif protein 43
  Uniprot ID: Q6ZSC3
  ENSP ID: ENSP00000331211
MASVLNVKESKAPERTVVVAGLPVDLFSDQLLAVLVKSHFQDIKNEGGDVEDVIYPTRTKGVAYVIFKEKKVAENVIRQKKHWLARKTRHAELTVSLRVSHFGDKIFSSVNAILDLSVFGKEVTLETLVKDLKKKIPSLSFSPLKPNGRISVEGSFLAVKRLRESLLARACSLLEKDRNFTSEERKWNRQNPQRNLQRSNNSLASVRTLVPETARSGEMLVLDTDVFLYLKHKCGSYESTLKKFHILSQEKVDGEITTICLKSIQVGSQPNNAKHVKELIEEWSHALYLKLRKETFILEGKENREKRMIKRACEQLSSRYLEVLINLYRTHIDIIGSSSDTYLFKKGVMKLIGQKVS

SEQ ID NO: 75317 - protein, 68 aa, Homo sapiens
  Payload ID: 14880
  Gene Symbol: RBM43
  Gene Name: RNA binding motif protein 43
  ENSP ID: ENSP00000386440
MVAALRAPEIHVRRCSIGPLQRLRTRLSPPTPTAQATGTPPFVEELLRRLLGLNCCPPTPRGEQKWPD

SEQ ID NO: 75318 - protein, 1052 aa, Homo sapiens
  Payload ID: 14881
  Gene Symbol: RBM44
  Gene Name: RNA binding motif protein 44
  ENSP ID: ENSP00000321179
MMQATAVVETASGKGYHSNGGNLQKDKPSNPKKENLLLSSNGCDEVKLTFPDDDWNSSTLEQRANNKEISNIDKMDLLEPFFSVSQDTNTESTQFQSSELEDSTDYAFLNKTYSIPYSESKLKKESLTPLSSELDPEVQKKEEVFFNILEHQDKTVGLERIYNISDANYRESAEDTQKHDTDEDSQQEYHSAEEQEYISNHLSFDQTKALDISNPEVVELGNSGYEVKCASNVEDNRVNSGSGSIISFDSLDVYGQEESLHVSKFQNSVMLREYHDLKHEKYKEQETNSMYHTVFDGSVLRSNSPGNQESQSKSGSLSPQKVLKMKIYTENMKSQINEGKDFCGNKIVENKILLHLENPSTLPQDKALETLLQPCKDCQTSWTSVFDDSIISACGYYESLQNTADSALDFSAMLPKIAVRDNQAIEDNTSLKVAHSSTTKKTCFHNIGEMCTKSLTDAASCTVTINQTVDVSTDFRACFTTSRATSARPSVVSTSSNTEITMMNKKRPDEWQNEKQKSVACSTDWSYSEDCIDTQMAITKGSGKSLSVDSLKPNGNFLNKDFLELRKACGITDLKKHPEREFQLFKDTEKDLPSMCCQKIMQRAIKAELHLLNVHYQMCRRHCCDIYKLVMENREGLNMNLSSNSAKKELGSALLSLLGDLKVRYVTLKEKIHKGIPLEELPPLSLESKLLSTFSTFASRLMKKETHVFSEADAEQDNQRAHDVDVSSNLKKTLSQMSLSSDNSHATQNISPKKDDFKNGDINADFSQLKLGDKDCRHYQETSEDWSDAKESLTGVDVSGTQGNQVEQDTWNLDLTGEMKNVEPSQRDKGYLIHVGGLCPSVSEADLRSHFQKYQVSEISIYDSTNYRYASLAFTKNSDAKIAVKEMNGIEINGKSVNVWPVKILGEYTSPLSSKNGNRISSNNLEKSTNKQIHSEFSISRLPRTRPRQLGSEQDSEVFPSDQGVKKNCKQIESAKLLPDTPVQFIPPNTLNLRSFTKIIKRLAELHPEVSRDHIINALQEVRIRHKGFLNGLSITTIVEMTSSLLKNSASS

SEQ ID NO: 75319 - protein, 1052 aa, Homo sapiens; identical to SEQ ID NO: 75318
  Payload ID: 14881
  Gene Symbol: RBM44
  Gene Name: RNA binding motif protein 44
  ENSP ID: ENSP00000386727

SEQ ID NO: 75320 - protein, 418 aa, Homo sapiens [sequence omitted]

SEQ ID NO: 75321 - protein, 474 aa, Homo sapiens
  Payload ID: 14882
  Gene Symbol: RBM45
  Gene Name: RNA binding motif protein 45
  Uniprot ID: Q8IUH3
  ENSP ID: ENSP00000286070
MDEAGSSASGGGFRPGVDSLDEPPNSRIFLVISKYTPESVLRERFSPFGDIQDIWVVRDKHTKESKGIAFVKFARSSQACRAMEEMHGQCLGPNDTKPIKVFIAQSRSSGSHRDVEDEELTRIFVMIPKSYTEEDLREKFKVYGDIEYCSIIKNKVTGESKGLGYVRYLKPSQAAQAIENCDRSFRAILAEPKNKASESSEQDYYSNMRQEALGHEPRVNMFPFEQQSEFSSFDKNDSRGQEAISKRLSVVSRVPFTEEQLFSIFDIVPGLEYCEVQRDPYSNYGHGVVQYFNVASAIYAKYKLHGFQYPPGNRIGVSFIDDGSNATDLLRKMATQMVAAQLASMVWNNPSQQQFMQFGGSSGSQLPQIQTDVVLPSCKKKAPAETPVKERLFIVFNPHPLPLDVLEDIFCRFGNLIEVYLVSGKNVGYAKYADRISANDAIATLHGKILNGVRLKVMLADSPREESNKRQRTY

SEQ ID NO: 75322 - protein, 73 aa, Homo sapiens
  Payload ID: 14882
  Gene Symbol: RBM45
  Gene Name: RNA binding motif protein 45
  ENSP ID: ENSP00000389134
  MOD_RES (1)..(1): Any amino acid
XWIEEGQAQGRFGNLIEVYLVSGKNVGYAKYADRISANDAIATLHGKILNGVRLKVMLADSPREESNKRQRTY

SEQ ID NO: 75323 - protein, 135 aa, Homo sapiens
  Payload ID: 14882
  Gene Symbol: RBM45
  Gene Name: RNA binding motif protein 45
  ENSP ID: ENSP00000415940
  MOD_RES (1)..(1): Any amino acid
XQLASMVWNNPSQQQFMQFGGSSGSQLPQIQTDVVLPSCKKKAPAETPVKERLFIVFNPHPLPLDVLEDIFCRFGNLIEVYLVSGKNVGYAKYADRISANDAIATLHGKILNGVRLKVMLADSPREESNKRQRTY

SEQ ID NO: 75324 - protein, 476 aa, Homo sapiens
  Payload ID: 14882
  Gene Symbol: RBM45
  Gene Name: RNA binding motif protein 45
  Uniprot ID: Q8IUH3
  ENSP ID: ENSP00000482083
MDEAGSSASGGGFRPGVDSLDEPPNSRIFLVISKYTPESVLRERFSPFGDIQDIWVVRDKHTKESKGIAFVKFARSSQACRAMEEMHGQCLGPNDTKPIKVFIAQSRSSGSHRDVEDEELTRIFVMIPKSYTEEDLREKFKVYGDIEYCSIIKNKVTGESKGLGYVRYLKPSQAAQAIENCDRSFRAILAEPKNKASESSEQDYYSNMRQEALGHEPRVNMFPFVGEQQSEFSSFDKNDSRGQEAISKRLSVVSRVPFTEEQLFSIFDIVPGLEYCEVQRDPYSNYGHGVVQYFNVASAIYAKYKLHGFQYPPGNRIGVSFIDDGSNATDLLRKMATQMVAAQLASMVWNNPSQQQFMQFGGSSGSQLPQIQTDVVLPSCKKKAPAETPVKERLFIVFNPHPLPLDVLEDIFCRFGNLIEVYLVSGKNVGYAKYADRISANDAIATLHGKILNGVRLKVMLADSPREESNKRQRTY

SEQ ID NO: 75325 - protein, 533 aa, Homo sapiens
  Payload ID: 14883
  Gene Symbol: RBM46
  Gene Name: RNA binding motif protein 46
  Uniprot ID: Q8TBY0
  ENSP ID: ENSP00000281722
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIGVCVSLDNCRLFIGAIPKEKKKEEILDEMKKVTEGVVDVIVYPSATDKTKNRGFAFVEYESHRAAAMARRKLIPGTFQLWGHTIQVDWADPEKEVDEETMQRVKVLYVRNLMISTTEETIKAEFNKFKPGAVERVKKLRDYAFVHFFNREDAVAAMSVMNGKCIDGASIEVTLAKPVNKENTWRQHLNGQISPNSENLIVFANKEESHPKTLGKLPTLPARLNGQHSPSPPEVERCTYPFYPGTKLTPISMYSLKSNHFNSAVMHLDYYCNKNNWAPPEYYLYSTTSQDGKVLLVYKIVIPAIANGSQSYFMPDKLCTTLEDAKELAAQFTLLHLDYNFHRSSINSLSPVSATLSSGTPSVLPYTSRPYSYPGYPLSPTISLANGSHVGQRLCISNQASFF

SEQ ID NO: 75326 - protein, 470 aa, Homo sapiens
  Payload ID: 14883
  Gene Symbol: RBM46
  Gene Name: RNA binding motif protein 46
  Uniprot ID: Q8TBY0
  ENSP ID: ENSP00000422813
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIGVCVSLDNCRLFIGAIPKEKKKEEILDEMKKVTEGVVDVIVYPSATDKTKNRGFAFVEYESHRAAAMARRKLIPGTFQLWGHTIQVDWADPEKEVDEETMQRVKVLYVRNLMISTTEETIKAEFNKFKPGAVERVKKLRDYAFVHFFNREDAVAAMSVMNGKCIDGASIEVTLAKPVNKENTWRQHLNGQISPNSENLIVFANKEESHPKTLGKLPTLPARLNGQHSPSPPEVERCTYPFYPGTKLTPISMYSLKSNHFNSAVMHLDYYCNKNNWAPPEYYLYSTTSQDGKVLLVYKIVIPAIANGSQSYFMPDKLCTTLEDAKELAAQFTLLHLGPF

SEQ ID NO: 75327 - protein, 485 aa, Homo sapiens
  Payload ID: 14883
  Gene Symbol: RBM46
  Gene Name: RNA binding motif protein 46
  Uniprot ID: Q8TBY0
  ENSP ID: ENSP00000424500
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIGVCVSLDNCRLFIGAIPKEKKKEEILDEMKKVTEGVVDVIVYPSATDKTKNRGFAFVEYESHRAAAMARRKLIPGTFQLWGHTIQVDWADPEKEVDEETMQRVKVLYVRNLMISTTEETIKAEFNKFKPGAVERVKKLRDYAFVHFFNREDAVAAMSVMNGKCIDGASIEVTLAKPVNKENTWRQHLNGQISPNSENLIVFANKEESHPKTLGKLPTLPARLNGQHSPSPPEVERCTYPFYPGTKLTPISMYSLKSNHFNSAVMHLDYYCNKNNWAPPEYYLYSTTSQDGKVLLVYKIVIPAIANGSQSYFMPDKLCTTLEDAKELAAQFTLLHLDREHNLFSLDLCRRIWRK

SEQ ID NO: 75328 - protein, 133 aa, Homo sapiens
  Payload ID: 14883
  Gene Symbol: RBM46
  Gene Name: RNA binding motif protein 46
  ENSP ID: ENSP00000426672
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIG

SEQ ID NO: 75329 - protein, 593 aa, Homo sapiens
  Payload ID: 14884
  Gene Symbol: RBM47
  Gene Name: RNA binding motif protein 47
  Uniprot ID: A0AV96
  ENSP ID: ENSP00000295971
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAMYGGYAGYIPQAFPAAAIQVPIPDVYQTY

SEQ ID NO: 75330 - protein, 593 aa, Homo sapiens; identical to SEQ ID NO: 75329
  Payload ID: 14884
  Gene Symbol: RBM47
  Gene Name: RNA binding motif protein 47
  Uniprot ID: A0AV96
  ENSP ID: ENSP00000371212

SEQ ID NO: 75331 - protein, 524 aa, Homo sapiens
  Payload ID: 14884
  Gene Symbol: RBM47
  Gene Name: RNA binding motif protein 47
  Uniprot ID: A0AV96
  ENSP ID: ENSP00000371214
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAMYGGYAGYIPQAFPAAAIQVPIPDVYQTY

SEQ ID NO: 75332 - protein, 193 aa, Homo sapiens
  Payload ID: 14884
  Gene Symbol: RBM47
  Gene Name: RNA binding motif protein 47
  ENSP ID: ENSP00000421589
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKN

SEQ ID NO: 75333 - protein, 217 aa, Homo sapiens
  Payload ID: 14884
  Gene Symbol: RBM47
  Gene Name: RNA binding motif protein 47
  ENSP ID: ENSP00000422564
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPG

SEQ ID NO: 75334 - protein, 393 aa, Homo sapiens
  Payload ID: 14884
  Gene Symbol: RBM47
  Gene Name: RNA binding motif protein 47
  ENSP ID: ENSP00000422945
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKDTILETHPASLPLVLRRHA

SEQ ID NO: 75335 - protein, 555 aa, Homo sapiens
  Payload ID: 14884
  Gene Symbol: RBM47
  Gene Name: RNA binding motif protein 47
  ENSP ID: ENSP00000423243
MERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAAAAAMYGGYAGYIPQAFPAAAIQVPIPDVYQTY

SEQ ID NO: 75336 - protein, 123 aa, Homo sapiens
  Payload ID: 14884
  Gene Symbol: RBM47
  Gene Name: RNA binding motif protein 47
  ENSP ID: ENSP00000423398
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHE

SEQ ID NO: 75337 - protein, 158 aa, Homo sapiens
  Payload ID: 14884
  Gene Symbol: RBM47
  Gene Name: RNA binding motif protein 47
  ENSP ID: ENSP00000423527
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGI

SEQ ID NO: 75338 - protein, 113 aa, Homo sapiens
  Payload ID: 14884
  Gene Symbol: RBM47
  Gene Name: RNA binding motif protein 47
  ENSP ID: ENSP00000424019
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGY

SEQ ID NO: 75339 - protein, 59 aa, Homo sapiens
  Payload ID: 14884
  Gene Symbol: RBM47
  Gene Name: RNA binding motif protein 47
  ENSP ID: ENSP00000425111
MTAEDSTAAMSSDSAAGSSAKVPEGVAGAPNEAALLALMERTGYSMVQENGQRKYGGPP

SEQ ID NO: 75340 - protein, 59 aa, Homo sapiens; identical to SEQ ID NO: 75339
  Payload ID: 14884
  Gene Symbol: RBM47
  Gene Name: RNA binding motif protein 47
  ENSP ID: ENSP00000425507

SEQ ID NO: 75341 - protein, 137 aa, Homo sapiens
  Payload ID: 14884
  Gene Symbol: RBM47
  Gene Name: RNA binding motif protein 47
  ENSP ID: ENSP00000426542
MTAEDSTAAMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIR

SEQ ID NO: 75342 - protein, 367 aa, Homo sapiens
  Payload ID: 14885
  Gene Symbol: RBM48
  Gene Name: RNA binding motif protein 48
  Uniprot ID: Q5RL73
  ENSP ID: ENSP00000265732
MASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFGGLLHVCYAPEFETVEETRKKLQMRKAYVVKTTENKDHYVTKKKLVTEHKDTEDFRQDFHSEMSGFCKAALNTSAGNSNPYLPYSCELPLCYFSSKCMCSSGGPVDRAPDSSKDGRNHHKTMGHYNHNDSLRKTQINSLKNSVACPGAQKAITSSEAVDRFMPRTTQLQERKRRREDDRKLGTFLQTNPTGNEIMIGPLLPDISKVDMHDDSLNTTANLIRHKLKEVISSVPKPPEDKPEDVHTSHPLKQRRRI

SEQ ID NO: 75343 - protein, 91 aa, Homo sapiens
  Payload ID: 14885
  Gene Symbol: RBM48
  Gene Name: RNA binding motif protein 48
  ENSP ID: ENSP00000418333
MKELVERFALYGAIEQYNALDEYPAEDFTEVYLIKFMNLQSARTAKRKMDEQSFFGGLLHVCYAPEFETVEETRKKLQMRKAYVVKTTENK

SEQ ID NO: 75344 - protein, 376 aa, Homo sapiens
  Payload ID: 14885
  Gene Symbol: RBM48
  Gene Name: RNA binding motif protein 48
  Uniprot ID: Q5RL73
  ENSP ID: ENSP00000419242
MASSGGELGSLFDHHVQRAVCDTRAKYREGRRPRAVKVYTINLESQYLLIQGVPAVGVMKELVERFALYGAIEQYNALDEYPAEDFTEVYLIKFMNLQSARTAKRKMDEQSFFGGLLHVCYAPEFETVEETRKKLQMRKAYVVKTTENKDHYVTKKKLVTEHKDTEDFRQDFHSEMSGFCKAALNTSAGNSNPYLPYSCELPLCYFSSKCMCSSGGPVDRAPDSSKDGRNHHKTMGHYNHNDSLRKTQINSLKNSVACPGAQKAITSSEAVDRFMPRTTQLQERKRRREDDRKLGTFLQTNPTGNEIMIGPLLPDISKVDMHDDSLNTTANLIRHKLKEVRLFLKNYSKTRFGYRIKWRIICGNNSTVIFFHFLVF

SEQ ID NO: 75345 - protein, 360 aa, Homo sapiens [sequence omitted]

SEQ ID NO: 75346 - protein, 359 aa, Homo sapiens
  Payload ID: 14886
  Gene Symbol: RBM4B
  Gene Name: RNA binding motif protein 4B
  Uniprot ID: Q9BQ04
  ENSP ID: ENSP00000310471
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGKRMHVQLSTSRLRTAPGMGDQSGCYRCGKEGHWSKECPVDRTGRVADFTEQYNEQYGAVRTPYTMGYGESMYYNDAYGALDYYKRYRVRSYEAVAAAAAASAYNYAEQTMSHLPQVQSTTVTSHLNSTSVDPYDRHLLPNSGAAATSAAMAAAAATTSSYYGRDRSPLRRAAAMLPTVGEGYGYGPESELSQASAATRNSLYDMARYEREQYVDRARYSAF

SEQ ID NO: 75347 - protein, 359 aa, Homo sapiens; identical to SEQ ID NO: 75346
  Payload ID: 14886
  Gene Symbol: RBM4B
  Gene Name: RNA binding motif protein 4B
  Uniprot ID: Q9BQ04
  ENSP ID: ENSP00000433071

SEQ ID NO: 75348 - protein, 147 aa, Homo sapiens
  Payload ID: 14886
  Gene Symbol: RBM4B
  Gene Name: RNA binding motif protein 4B
  ENSP ID: ENSP00000433113
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGWWSTRLPLA

SEQ ID NO: 75349 - protein, 20 aa, Homo sapiens
  Payload ID: 14886
  Gene Symbol: RBM4B
  Gene Name: RNA binding motif protein 4B
  ENSP ID: ENSP00000433601
  MOD_RES (1)..(1): Any amino acid
XDMARYEREQYVDRARYSAF

SEQ ID NO: 75350 - protein, 143 aa, Homo sapiens
  Payload ID: 14886
  Gene Symbol: RBM4B
  Gene Name: RNA binding motif protein 4B
  ENSP ID: ENSP00000435239
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGRIIAD

SEQ ID NO: 75351 - protein, 151 aa, Homo sapiens
  Payload ID: 14886
  Gene Symbol: RBM4B
  Gene Name: RNA binding motif protein 4B
  ENSP ID: ENSP00000475784
MVKLFIGNLPREATEQEIRSLFEQYGKVLECDIIKNYGFVHIEDKTAAEDAIRNLHHYKLHGVNINVEASKNKSKASTKLHVGNISPTCTNQELRAKFEEYGPVIECDIVKDYAFVHMERAEDAVEAIRGLDNTEFQGELLWAWVVAPSGV

SEQ ID NO: 75352 - protein, 815 aa, Homo sapiens
  Payload ID: 14887
  Gene Symbol: RBM5
  Gene Name: RNA binding motif protein 5
  Uniprot ID: P52756
  ENSP ID: ENSP00000343054
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGVSRGFAFVEFYHLQDATSWMEANQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 75353 - protein, 56 aa, Homo sapiens
  Payload ID: 14887
  Gene Symbol: RBM5
  Gene Name: RNA binding motif protein 5
  ENSP ID: ENSP00000378603
RESVKEGTVTDPKMATIQMVTMVSTTIGMTSVTRGRARPSCCAAFPSPSQRAIFEK

SEQ ID NO: 75354 - protein, 138 aa, Homo sapiens
  Payload ID: 14887
  Gene Symbol: RBM5
  Gene Name: RNA binding motif protein 5
  ENSP ID: ENSP00000384872
MGSDKRVSRTERSGRYGSIIDRDDRDERESRSRRRDSDYKRSSDDRRGDRYDDYRDYDSPERERERRNSDRSEDGYHSDGDYDSRNDGVLRRPSACGCEADEEENRCKPWFRLRGVLSLARCYQLDGSQSEKVGDSRK

SEQ ID NO: 75355 - protein, 137 aa, Homo sapiens
  Payload ID: 14887
  Gene Symbol: RBM5
  Gene Name: RNA binding motif protein 5
  ENSP ID: ENSP00000390711
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTG

SEQ ID NO: 75356 - protein, 105 aa, Homo sapiens
  Payload ID: 14887
  Gene Symbol: RBM5
  Gene Name: RNA binding motif protein 5
  ENSP ID: ENSP00000394622
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGL

SEQ ID NO: 75357 - protein, 120 aa, Homo sapiens
  Payload ID: 14887
  Gene Symbol: RBM5
  Gene Name: RNA binding motif protein 5
  ENSP ID: ENSP00000406119
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMES

SEQ ID NO: 75358 - protein, 81 aa, Homo sapiens
  Payload ID: 14887
  Gene Symbol: RBM5
  Gene Name: RNA binding motif protein 5
  ENSP ID: ENSP00000414218
MGSDKRVSRTERSGRYGSIIDRDDRDERESRSRRRDSDYKRSSDDRRGDRYDDYRDYDSPELFSLVTQAGVQWCDLSYSGG

SEQ ID NO: 75359 - protein, 143 aa, Homo sapiens
  Payload ID: 14887
  Gene Symbol: RBM5
  Gene Name: RNA binding motif protein 5
  Uniprot ID: P52756
  ENSP ID: ENSP00000419534
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGESLLSS

SEQ ID NO: 75360 - protein, 1123 aa, Homo sapiens
  Payload ID: 14888
  Gene Symbol: RBM6
  Gene Name: RNA binding motif protein 6
  Uniprot ID: P78332
  ENSP ID: ENSP00000266022
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 75361 - protein, 76 aa, Homo sapiens
  Payload ID: 14888
  Gene Symbol: RBM6
  Gene Name: RNA binding motif protein 6
  ENSP ID: ENSP00000389763
MWGDSRPANRTGPFRGSQEERFAPGWNRDYPPPPLKSHAQERHSGNFPGRDSLPFDFQGHSGPPFANVEEHSFSYG

SEQ ID NO: 75362 - protein, 119 aa, Homo sapiens
  Payload ID: 14888
  Gene Symbol: RBM6
  Gene Name: RNA binding motif protein 6
  ENSP ID: ENSP00000392475
MIAGKSSSLLTLQKGNGLSTPGKLTGSDGVCFFCSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 75363 - protein, 601 aa, Homo sapiens
  Payload ID: 14888
  Gene Symbol: RBM6
  Gene Name: RNA binding motif protein 6
  Uniprot ID: P78332
  ENSP ID: ENSP00000392939
MIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 75364 - protein, 601 aa, Homo sapiens; identical to SEQ ID NO: 75363
  Payload ID: 14888
  Gene Symbol: RBM6
  Gene Name: RNA binding motif protein 6
  Uniprot ID: P78332
  ENSP ID: ENSP00000393530

SEQ ID NO: 75365 - protein, 156 aa, Homo sapiens
  Payload ID: 14888
  Gene Symbol: RBM6
  Gene Name: RNA binding motif protein 6
  ENSP ID: ENSP00000394336
MIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEP

SEQ ID NO: 75366 - protein, 35 aa, Homo sapiens
  Payload ID: 14888
  Gene Symbol: RBM6
  Gene Name: RNA binding motif protein 6
  ENSP ID: ENSP00000396410
MWGDSRPANRTGPFRVRQTLVGTDLPVHSARTQEK

SEQ ID NO: 75367 - protein, 991 aa, Homo sapiens
  Payload ID: 14888
  Gene Symbol: RBM6
  Gene Name: RNA binding motif protein 6
  ENSP ID: ENSP00000396466
MDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 75368 - protein, 199 aa, Homo sapiens
  Payload ID: 14888
  Gene Symbol: RBM6
  Gene Name: RNA binding motif protein 6
  ENSP ID: ENSP00000399942
MIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHACVWFYRKLFVW

SEQ ID NO: 75369 - protein, 120 aa, Homo sapiens
  Payload ID: 14888
  Gene Symbol: RBM6
  Gene Name: RNA binding motif protein 6
  ENSP ID: ENSP00000403865
MHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKA

SEQ ID NO: 75370 - protein, 697 aa, Homo sapiens
  Payload ID: 14888
  Gene Symbol: RBM6
  Gene Name: RNA binding motif protein 6
  ENSP ID: ENSP00000406548
MDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQVSLGLFFFFFFFYLCQ

SEQ ID NO: 75371 - protein, 520 aa, Homo sapiens
  Payload ID: 14888
  Gene Symbol: RBM6
  Gene Name: RNA binding motif protein 6
  Uniprot ID: P78332
  ENSP ID: ENSP00000408665
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGNSNDPGQRSYPGVCIKPGFLVLQTM

SEQ ID NO: 75372 - protein, 267 aa, Homo sapiens
  Payload ID: 14889
  Gene Symbol: RBM7
  Gene Name: RNA binding motif protein 7
  ENSP ID: ENSP00000364639
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 75373 - protein, 70 aa, Homo sapiens
  Payload ID: 14889
  Gene Symbol: RBM7
  Gene Name: RNA binding motif protein 7
  ENSP ID: ENSP00000437847
MGAAAAEADRTLFVGNLETKVTEELLFELFHQEVVMPHKMSVCHIPNIMLEIQALPPHLLAAGTKGLWIT

SEQ ID NO: 75374 - protein, 123 aa, Homo sapiens
  Payload ID: 14889
  Gene Symbol: RBM7
  Gene Name: RNA binding motif protein 7
  ENSP ID: ENSP00000437998
MGAAAAEADRTLFVGNLETKVTEELLFELFHQAGPVIKVKIPKDKDGKPKQFAFVNFKHEVSVPYAMNLLNGIKLYGRPIKIQFRSVVMPHKMSVCHIPNIMLEIQALPPHLLAAGTKGLWIT

SEQ ID NO: 75375 - protein, 266 aa, Homo sapiens
  Payload ID: 14889
  Gene Symbol: RBM7
  Gene Name: RNA binding motif protein 7
  Uniprot ID: Q9Y580
  ENSP ID: ENSP00000439918
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 75376 - protein, 220 aa, Homo sapiens
  Payload ID: 14889
  Gene Symbol: RBM7
  Gene Name: RNA binding motif protein 7
  ENSP ID: ENSP00000440923
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSRYERTMDNMTSSAQIIQRSFSSPENFQRQAVVVSSNLYTDQLSHEYGRKPAGLREFSPCATYRFSVLCTGHSSCLCFAGLSAVSSELSEFARLCLPCPPTPHNAA

SEQ ID NO: 75377 - protein, 149 aa, Homo sapiens
  Payload ID: 14889
  Gene Symbol: RBM7
  Gene Name: RNA binding motif protein 7
  ENSP ID: ENSP00000440949
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSSRYERTMDNMTSSAQIIQRSFSSPENFQRQAVVG

SEQ ID NO: 75378 - protein, 146 aa, Homo sapiens
  Payload ID: 14889
  Gene Symbol: RBM7
  Gene Name: RNA binding motif protein 7
  ENSP ID: ENSP00000445848
MDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 75379 - protein, 146 aa, Homo sapiens; identical to SEQ ID NO: 75378
  Payload ID: 14889
  Gene Symbol: RBM7
  Gene Name: RNA binding motif protein 7
  ENSP ID: ENSP00000485655

SEQ ID NO: 75380 - protein, 173 aa, Homo sapiens
  Payload ID: 14890
  Gene Symbol: RBM8A
  Gene Name: RNA binding motif protein 8A
  Uniprot ID: Q9Y5S9
  ENSP ID: ENSP00000358313
MADVLDLHEAGGEDFAMDEDGDESIHKLKEKAKKRKGRGFGSEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 75381 - protein, 174 aa, Homo sapiens
  Payload ID: 14890
  Gene Symbol: RBM8A
  Gene Name: RNA binding motif protein 8A
  Uniprot ID: Q9Y5S9
  ENSP ID: ENSP00000463058
MADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 75382 - protein, 106 aa, Homo sapiens
  Payload ID: 14890
  Gene Symbol: RBM8A
  Gene Name: RNA binding motif protein 8A
  ENSP ID: ENSP00000487764
  MOD_RES (1)..(1): Any amino acid
XVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 75383 - protein, 174 aa, Homo sapiens; identical to SEQ ID NO: 75381
  Payload ID: 14890
  Gene Symbol: RBM8A
  Gene Name: RNA binding motif protein 8A
  Uniprot ID: Q9Y5S9
  ENSP ID: ENSP00000488265

SEQ ID NO: 75384 - protein, 106 aa, Homo sapiens; identical to SEQ ID NO: 75382
  Payload ID: 14890
  Gene Symbol: RBM8A
  Gene Name: RNA binding motif protein 8A
  ENSP ID: ENSP00000488887
  MOD_RES (1)..(1): Any amino acid

SEQ ID NO: 75385 - protein, 391 aa, Homo sapiens
  Payload ID: 14891
  Gene Symbol: RBMX
  Gene Name: RNA binding motif protein, X-linked
  Uniprot ID: P38159
  ENSP ID: ENSP00000359645
MVEADRPGKLFIGGLNTETNEKALEAVFGKYGRIVEVLLMKDRETNKSRGFAFVTFESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 75386 - protein, 292 aa, Homo sapiens
  Payload ID: 14891
  Gene Symbol: RBMX
  Gene Name: RNA binding motif protein, X-linked
  ENSP ID: ENSP00000405117
  MOD_RES (1)..(1): Any amino acid
XNMVEADRPGKLFIGGLNTETNEKALEAVFGKYGRIVEVLLMKDRETNKSRGFAFVTFESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGW

SEQ ID NO: 75387 - protein, 196 aa, Homo sapiens
  Payload ID: 14891
  Gene Symbol: RBMX
  Gene Name: RNA binding motif protein, X-linked
  Uniprot ID: P38159
  ENSP ID: ENSP00000411989
MVEADRPGKLFIGGLNTETNEKALEAVFGKYGRIVEVLLMKDRETNKSRGFAFVTFESPADAKDAARDMNGKLLYHVEEIVMEVHLEGNRCPLVEMFICPQEMMGILLKTAIQAEITQVLVILEIMHHHHEIILTVIMVIPVHVMTIHQEDIAIEMDMVVIVTIQIIQVEVPTEIHMRVMVGDFAHYGRGVLIDSQ

SEQ ID NO: 75388 - protein, 37 aa, Homo sapiens
  Payload ID: 14891
  Gene Symbol: RBMX
  Gene Name: RNA binding motif protein, X-linked
  ENSP ID: ENSP00000454777
MVEADRPGKLFIGGLNTETNEKALEAVFGKYGRIVEG

SEQ ID NO: 75389 - protein, 78 aa, Homo sapiens
  Payload ID: 14891
  Gene Symbol: RBMX
  Gene Name: RNA binding motif protein, X-linked
  ENSP ID: ENSP00000456048
MVEADRPGKLFIGGLNTETNEKALEAVFGKYGRIVEVLLMKDRETNKSRGFAFVTFESPADAKDAARDMNGKMTVDIP

SEQ ID NO: 75390 - protein, 296 aa, Homo sapiens
  Payload ID: 14891
  Gene Symbol: RBMX
  Gene Name: RNA binding motif protein, X-linked
  ENSP ID: ENSP00000457051
MVEADRPGKLFIGGLNTETNEKALEAVFGKYGRIVEVLLMKDRETNKSRGFAFVTFESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGKILVKGL

SEQ ID NO: 75391 - protein, 78 aa, Homo sapiens; identical to SEQ ID NO: 75389
  Payload ID: 14891
  Gene Symbol: RBMX
  Gene Name: RNA binding motif protein, X-linked
  ENSP ID: ENSP00000457691

SEQ ID NO: 75392 - protein, 263 aa, Homo sapiens
  Payload ID: 14891
  Gene Symbol: RBMX
  Gene Name: RNA binding motif protein, X-linked
  ENSP ID: ENSP00000457866
MDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 75393 - protein, 322 aa, Homo sapiens
  Payload ID: 14892
  Gene Symbol: RBMX2
  Gene Name: RNA binding motif protein, X-linked 2
  Uniprot ID: Q9Y388
  ENSP ID: ENSP00000339090
MNPLTKVKLINELNEREVQLGVADKVSWHSEYKDSAWIFLGGLPYELTEGDIICVFSQYGEIVNINLVRDKKTGKSKGFCFLCYEDQRSTILAVDNFNGIKIKGRTIRVDHVSNYRAPKDSEEIDDVTRQLQEKGCGARTPSPSLSESSEDEKPTKKHKKDKKEKKKKKKEKEKADREVQAEQPSSSSPRRKTVKEKDDTGPKKHSSKNSERAQKSEPREGQKLPKSRTAYSGGAEDLERELKKEKPKHEHKSSSRREAREEKTRIRDRGRSSDAHSSWYNGRSEGRSYRSRSRSRDKSHRHKRARRSRERESSNPSDRWRH

SEQ ID NO: 75394 - protein, 58 aa, Homo sapiens
  Payload ID: 14892
  Gene Symbol: RBMX2
  Gene Name: RNA binding motif protein, X-linked 2
  ENSP ID: ENSP00000359985
MNPLTKVKLINELNEREVQLGVADKVSWHSEYKDSAWIFLGGLPYELTEGDIICVFSQ

SEQ ID NO: 75395 - protein, 275 aa, Homo sapiens
  Payload ID: 14892
  Gene Symbol: RBMX2
  Gene Name: RNA binding motif protein, X-linked 2
  ENSP ID: ENSP00000478689
MNPLTKVKLINELNEREVQLGVADKVSWHSEYKDSAWIFLGGLPYELTEGDIICVFSQYGEIVNINLVRDKKTGKSKGFCFLCYEDQRSTILAVDNFNGIKIKGRTIRVDHVSNYRAPKDSEEIDDVTRQLQEKGCGARTPSPSLSESSEDEKPTKKHKKDKKEKKKKKKEKEKADREVQAEQPSSSSPRRKTVKEKDDTGPKKHSSKNSERAQKSEPREGQKLPKSRTAYSGGAEDLERELKKEKPKHEHKSSSRREAREEKTRIRDRGLRCTF

SEQ ID NO: 75396 - protein, 390 aa, Homo sapiens
  Payload ID: 14893
  Gene Symbol: RBMXL1
  Gene Name: RNA binding motif protein, X-linked-like 1
  Uniprot ID: Q96E39
  ENSP ID: ENSP00000318415
MVEADRPGKLFIGGLNTETNEKALETVFGKYGRIVEVLLIKDRETNKSRGFAFVTFESPADAKDAARDMNGKSLDGKAIKVEQATKPSFERGRHGPPPPPRSRGPPRGFGAGRGGSGGTRGPPSRGGHMDDGGYSMNFNMSSSRGPLPVKRGPPPRSGGPSPKRSAPSGLVRSSSGMGGRAPLSRGRDSYGGPPRREPLPSRRDVYLSPRDDGYSTKDSYSSRDYPSSRDTRDYAPPPRDYTYRDYGHSSSRDDYPSRGYGDRDGYGRDRDYSDHPSGGSYRDSYESYGNSRSAPLTRGPPPSYGGSSRYDDYSSSRDGYGGSRDSYSSSRSDLYSSCDRVGRQERGLPPSVERGYPSSRDSYSSSSRGAPRGAGPGGSRSDRGGGRSRY

SEQ ID NO: 75397 - protein, 390 aa, Homo sapiens; identical to SEQ ID NO: 75396
  Payload ID: 14893
  Gene Symbol: RBMXL1
  Gene Name: RNA binding motif protein, X-linked-like 1
  Uniprot ID: Q96E39
  ENSP ID: ENSP00000446099

SEQ ID NO: 75398 - protein, 392 aa, Homo sapiens
  Payload ID: 14894
  Gene Symbol: RBMXL2
  Gene Name: RNA binding motif protein, X-linked-like 2
  Uniprot ID: O75526
  ENSP ID: ENSP00000304139
MVEADRPGKLFIGGLNLETDEKALEAEFGKYGRIVEVLLMKDRETNKSRGFAFVTFESPADAKAAARDMNGKSLDGKAIKVAQATKPAFESSRRGPPPPRSRGRPRFLRGTRGGGGGPRRSPSRGGPDDDGGYTADFDLRPSRAPMPMKRGPPPRRVGPPPKRAAPSGPARSSGGGMRGRALAVRGRDGYSGPPRREPLPPRRDPYLGPRDEGYSSRDGYSSRDYREPRGFAPSPGEYTHRDYGHSSVRDDCPLRGYSDRDGYGGRDRDYGDHLSRGSHREPFESYGELRGAAPGRGTPPSYGGGGRYEEYRGYSPDAYSGGRDSYSSSYGRSDRYSRGRHRVGRPDRGLSLSMERGCPPQRDSYSRSGCRVPRGGGRLGGRLERGGGRSRY

SEQ ID NO: 75399 - protein, 1067 aa, Homo sapiens
  Payload ID: 14895
  Gene Symbol: RBMXL3
  Gene Name: RNA binding motif protein, X-linked-like 3
  Uniprot ID: Q8N7X1
  ENSP ID: ENSP00000417451
MMEADRPEKLFIGGLNLKTDEKALKAEFGKYGHIIKVFLMKDRKTNKSRGFAFVTFESPADAKAAARDMNGKYLDGKAIMVAQTIKPAFKSSRWVPPTPGSGSRSRFSHRTRGGGSSPQRPPSQGRPDDGRGYAGYFDLWPYRAPMPRKRGPPPRHWASPPHKRATPSSLAHSVGCGMRGKAPTVSGQDGYSGLQPRRWAGPPHKRAVPRSSLARIGGSGMPGKAPAVWGQDGYSGPRVREPLPPCRDPGDFVPALRDYSRRYYGHSSVPDYRPLRGDGNQNGYRGRDHEYTDHPSKGSYREPLKSYGGPCGAAPVWGTPPSYGGGCRYEEYQGNSPDACSEGRSSEALPVVLPDAYSRDHSPKAYSGGRSSSSNGYSRSDRYGEEGCYEEYRGRSPDAHSGGRNSSSNSYGQSHHYGGEGRYEEYRGRSHEARSGGRSTDAHSRGRSDDAYSGGHDSSSWSDCCGGGGRYEEYQGRSLDANSGGCSPEAYSGGHDNSSWSDRYGVGGHYEENRGHSLDANSGGRSPDTHSGGHSSSSNSYGQSHRYGGEGRYEYRGRSHDAHSGGCSADAYSGGHDSSSQSNRYGGGGCYEEYRGRSLDANSGGRSPNAYSGGHDSSSWSHRYGGGGRYEEYRGRSLDANSGGRSPDAYSGGHDSSGQSNCYGGGGRYEEYRGRLLDANSGGRSPDAYSGGHDSSSQSNRYGGGGRYEEYRGHSLDANSGGRSPDTYSRGHDSSSQSDHYGGGGRSLDANSSGRLPDAYSGGHDSSSRSHRYGGGGRYEEYRGRSLDANSGGRSPNAYSGGHNSSSRNDPCRGGGRYEENRGHSLDANSGGHSPNAYSGGRDSSSNSYDRSHRYGGGGHYEEYRGRSHDTHSRGRSPDAHSGDHYTEAYSRGRDSFSNSYGRSDHYGRGGCYEEYQGRSPNAYGGGRGLNSSNNSHGRSHRYGGGGRYEEYRGPSPDAHSGGRDSSIKSYGLSDRYGGGGHYEEYQGSLPDAYSGDHDRSSNSYGRSDRYSRGRDRVGRPDRGLPLPMETGSPPLHDSYSRSGCRVPRGGGRQGGRFERGEGRSRY

SEQ ID NO: 75400 - protein, 459 aa, Homo sapiens
  Payload ID: 14896
  Gene Symbol: RBMY1A1
  Gene Name: RNA binding motif protein, Y-linked, family 1, member A1
  Uniprot ID: P0DJD3
  ENSP ID: ENSP00000303712
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 75401 - protein, 81 aa, Homo sapiens
  Payload ID: 14896
  Gene Symbol: RBMY1A1
  Gene Name: RNA binding motif protein, Y-linked, family 1, member A1
  ENSP ID: ENSP00000354329
MVEADHPGKLFIGGLNRETNEKMLKAVFGKHGPISEVLLIKDRTSKSRGFAFITFENPADAKNAAKDMNGKMMVDTLLISR

SEQ ID NO: 75402 - protein, 496 aa, Homo sapiens
  Payload ID: 14896
  Gene Symbol: RBMY1A1
  Gene Name: RNA binding motif protein, Y-linked, family 1, member A1
  Uniprot ID: P0DJD3
  ENSP ID: ENSP00000372154
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 75403 - protein, 496 aa, Homo sapiens; identical to SEQ ID NO: 75402
  Payload ID: 14896
  Gene Symbol: RBMY1A1
  Gene Name: RNA binding motif protein, Y-linked, family 1, member A1
  Uniprot ID: P0DJD3
  ENSP ID: ENSP00000388006

SEQ ID NO: 75404 - protein, 81 aa, Homo sapiens; identical to SEQ ID NO: 75401
  Payload ID: 14897
  Gene Symbol: RBMY1B
  Gene Name: RNA binding motif protein, Y-linked, family 1, member B
  ENSP ID: ENSP00000372084

SEQ ID NO: 75405 - protein, 496 aa, Homo sapiens
  Payload ID: 14897
  Gene Symbol: RBMY1B
  Gene Name: RNA binding motif protein, Y-linked, family 1, member B
  Uniprot ID: A6NDE4
  ENSP ID: ENSP00000372484
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 75406 - protein, 459 aa, Homo sapiens
  Payload ID: 14897
  Gene Symbol: RBMY1B
  Gene Name: RNA binding motif protein, Y-linked, family 1, member B
  ENSP ID: ENSP00000481627
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 75407 - protein, 81 aa, Homo sapiens; identical to SEQ ID NO: 75401
  Payload ID: 14898
  Gene Symbol: RBMY1D
  Gene Name: RNA binding motif protein, Y-linked, family 1, member D
  ENSP ID: ENSP00000372099

SEQ ID NO: 75408 - protein, 496 aa, Homo sapiens
  Payload ID: 14898
  Gene Symbol: RBMY1D
  Gene Name: RNA binding motif protein, Y-linked, family 1, member D
  Uniprot ID: P0C7P1
  ENSP ID: ENSP00000372127
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 75409 - protein, 459 aa, Homo sapiens; identical to SEQ ID NO: 75406
  Payload ID: 14898
  Gene Symbol: RBMY1D
  Gene Name: RNA binding motif protein, Y-linked, family 1, member D
  Uniprot ID: P0C7P1
  ENSP ID: ENSP00000399181

SEQ ID NO: 75410 - protein, 81 aa, Homo sapiens; identical to SEQ ID NO: 75401
  Payload ID: 14899
  Gene Symbol: RBMY1E
  Gene Name: RNA binding motif protein, Y-linked, family 1, member E
  ENSP ID: ENSP00000351823

SEQ ID NO: 75411 - protein, 459 aa, Homo sapiens
  Payload ID: 14899
  Gene Symbol: RBMY1E
  Gene Name: RNA binding motif protein, Y-linked, family 1, member E
  ENSP ID: ENSP00000372104
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYSYHDGYGEALGRDHSEHLSGSSYRDALQRYGTAHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 75412 - protein, 496 aa, Homo sapiens
  Payload ID: 14899
  Gene Symbol: RBMY1E
  Gene Name: RNA binding motif protein, Y-linked, family 1, member E
  Uniprot ID: A6NEQ0
  ENSP ID: ENSP00000372105
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSQEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTAHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 75413 - protein, 496 aa, Homo sapiens; identical to SEQ ID NO: 75408
  Payload ID: 14899
  Gene Symbol: RBMY1E
  Gene Name: RNA binding motif protein, Y-linked, family 1, member E
  ENSP ID: ENSP00000372119

SEQ ID NO: 75414 - protein, 496 aa, Homo sapiens
  Payload ID: 14900
  Gene Symbol: RBMY1F
  Gene Name: RNA binding motif protein, Y-linked, family 1, member F
  Uniprot ID: Q15415
  ENSP ID: ENSP00000307155
MVEADHPGKLFIGGLNRETNEKMLKAVFGKHGPISEVLLIKDRTSKSRGFAFITFENPADAKNAAKDMNGTSLHGKAIKVEQAKKPSFQSGGRRRPPASSRNRSPSGSLRSARGSSGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNHRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 75415 - protein, 459 aa, Homo sapiens
  Payload ID: 14900
  Gene Symbol: RBMY1F
  Gene Name: RNA binding motif protein, Y-linked, family 1, member F
  ENSP ID: ENSP00000406005
MVEADHPGKLFIGGLNRETNEKMLKAVFGKHGPISEVLLIKDRTSKSRGFAFITFENPADAKNAAKDMNGTSLHGKAIKVEQAKKPSFQSGGRRRPPASSRNRSPSGSLRSARGSSGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNHRSSRETREYAPPSRGHGYRDYGHSRRHESYSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREAYGSSSYVASIVDGGESRSEKGDSSRY

SEQ ID NO: 75416 - protein, 496 aa, Homo sapiens; identical to SEQ ID NO: 75414
  Payload ID: 14901
  Gene Symbol: RBMY1J
  Gene Name: RNA binding motif protein, Y-linked, family 1, member J
  Uniprot ID: Q15415
  ENSP ID: ENSP00000250831

SEQ ID NO: 75417 - protein, 459 aa, Homo sapiens; identical to SEQ ID NO: 75415
  Payload ID: 14901
  Gene Symbol: RBMY1J
  Gene Name: RNA binding motif protein, Y-linked, family 1, member J
  ENSP ID: ENSP00000389621

SEQ ID NO: 75418 - protein, 496 aa, Homo sapiens; identical to SEQ ID NO: 75414
  Payload ID: 14901
  Gene Symbol: RBMY1J
  Gene Name: RNA binding motif protein, Y-linked, family 1, member J
  Uniprot ID: Q15415
  ENSP ID: ENSP00000405745

SEQ ID NO: 75419 - protein, 406 aa, Homo sapiens
  Payload ID: 14902
  Gene Symbol: RBMS1
  Gene Name: RNA binding motif, single stranded interacting protein 1
  Uniprot ID: P29558
  ENSP ID: ENSP00000294904
MGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 75420 - protein, 386 aa, Homo sapiens [sequence omitted]

SEQ ID NO: 75421 - protein, 370 aa, Homo sapiens
  Payload ID: 14902
  Gene Symbol: RBMS1
  Gene Name: RNA binding motif, single stranded interacting protein 1
  ENSP ID: ENSP00000386347
MAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 75422 - protein, 370 aa, Homo sapiens; identical to SEQ ID NO: 75421
  Payload ID: 14902
  Gene Symbol: RBMS1
  Gene Name: RNA binding motif, single stranded interacting protein 1
  ENSP ID: ENSP00000386571

SEQ ID NO: 75423 - protein, 370 aa, Homo sapiens; identical to SEQ ID NO: 75421
  Payload ID: 14902
  Gene Symbol: RBMS1
  Gene Name: RNA binding motif, single stranded interacting protein 1
  ENSP ID: ENSP00000387280

SEQ ID NO: 75424 - protein, 127 aa, Homo sapiens
  Payload ID: 14902
  Gene Symbol: RBMS1
  Gene Name: RNA binding motif, single stranded interacting protein 1
  ENSP ID: ENSP00000389016
MAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENM

SEQ ID NO: 75425 - protein, 407 aa, Homo sapiens
  Payload ID: 14903
  Gene Symbol: RBMS2
  Gene Name: RNA binding motif, single stranded interacting protein 2
  Uniprot ID: Q15434
  ENSP ID: ENSP00000262031
MLLSVTSRPGISTFGYNRNNKKPYVSLAQQMAPPSPSNSTPNSSSGSNGNDQLSKTNLYIRGLQPGTTDQDLVKLCQPYGKIVSTKAILDKTTNKCKGYGFVDFDSPSAAQKAVTALKASGVQAQMAKQQEQDPTNLYISNLPLSMDEQELEGMLKPFGQVISTRILRDTSGTSRGVGFARMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQRVTQTSPLQVPNPSWMHHHSYLMQPSGSVLTPGMDHPISLQPASMMGPLTQQLGHLSLSSTGTYMPTAAAMQGAYISQYTPVPSSSVSVEESSGQQNQVAVDAPSEHGVYSFQFNK

SEQ ID NO: 75426 - protein, 262 aa, Homo sapiens
  Payload ID: 14903
  Gene Symbol: RBMS2
  Gene Name: RNA binding motif, single stranded interacting protein 2
  ENSP ID: ENSP00000443486
MAKAGVQWRDLDSLQPLPPRFKRFSHLCLLSSWDYRMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQRVTQTSPLQVPNPSWMHHHSYLMQPSGSVLTPGMDHPISLQPASMMGPLTQQLGHLSLSSTGTYMPTAAAMQGAYISQYTPVPSSSVSVEESSGQQNQVAVDAPSEHGVYSFQFNK

SEQ ID NO: 75427 - protein, 344 aa, Homo sapiens
  Payload ID: 14903
  Gene Symbol: RBMS2
  Gene Name: RNA binding motif, single stranded interacting protein 2
  ENSP ID: ENSP00000447426
MLLSVTSRPGISTFGYNRNNKKPYVSLAQQMAPPSPSNSTPNSSSGSNGNDQLSKTNLYIRGLQPGTTDQDLVKLCQPYGKIVSTKAILDKTTNKCKGYGFVDFDSPSAAQKAVTALKASGVQAQMAKQQEQDPTNLYISNLPLSMDEQELEGMLKPFGQVISTRILRDTSGTSRGVGFARMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQYMPTAAAMQGAYISQYTPVPSSSVSVEESSGQQNQVAVDAPSEHGVYSFQFNK

SEQ ID NO: 75428 - protein, 60 aa, Homo sapiens
  Payload ID: 14903
  Gene Symbol: RBMS2
  Gene Name: RNA binding motif, single stranded interacting protein 2
  ENSP ID: ENSP00000447699
MLLSVTSRPGISTFGYNRNNKKMEFRSLLLPRLECNGVISAHCNLCLPAICVIGSADGTT

SEQ ID NO: 75429 - protein, 282 aa, Homo sapiens
  Payload ID: 14903
  Gene Symbol: RBMS2
  Gene Name: RNA binding motif, single stranded interacting protein 2
  ENSP ID: ENSP00000449678
MAKQQEQDPTNLYISNLPLSMDEQELEGMLKPFGQVISTRILRDTSGTSRGVGFARMESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQRVTQTSPLQVPNPSWMHHHSYLMQPSGSVLTPGMDHPISLQPASMMGPLTQQLGHLSLSSTGTYMPTAAAMQGAYISQYTPVPSSSVSVEESSGQQNQVAVDAPSEHGVYSFQFNK

SEQ ID NO: 75430 - protein, 84 aa, Homo sapiens
  Payload ID: 14903
  Gene Symbol: RBMS2
  Gene Name: RNA binding motif, single stranded interacting protein 2
  ENSP ID: ENSP00000450127
MLLSVTSRPGISTFGYNRNNKKPYVSLAQQMAPPSPSNSTPNSSSGSNGNDQLSKTNLYIRGLQPGTTDQDLVKLCQPLWLCRF

SEQ ID NO: 75431 - protein, 420 aa, Homo sapiens
  Payload ID: 14904
  Gene Symbol: RBMS3
  Gene Name: RNA binding motif, single stranded interacting protein 3
  Uniprot ID: Q6XE24
  ENSP ID: ENSP00000273139
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 75432 - protein, 419 aa, Homo sapiens
  Payload ID: 14904
  Gene Symbol: RBMS3
  Gene Name: RNA binding motif, single stranded interacting protein 3
  Uniprot ID: Q6XE24
  ENSP ID: ENSP00000373276
MGKRLDQPQMYPQYTYYYPHYLQTKSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 75433 - protein, 437 aa, Homo sapiens
  Payload ID: 14904
  Gene Symbol: RBMS3
  Gene Name: RNA binding motif, single stranded interacting protein 3
  Uniprot ID: Q6XE24
  ENSP ID: ENSP00000373277
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 75434 - protein, 264 aa, Homo sapiens
  Payload ID: 14904
  Gene Symbol: RBMS3
  Gene Name: RNA binding motif, single stranded interacting protein 3
  ENSP ID: ENSP00000391934
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNG

SEQ ID NO: 75435 - protein, 436 aa, Homo sapiens
  Payload ID: 14904
  Gene Symbol: RBMS3
  Gene Name: RNA binding motif, single stranded interacting protein 3
  ENSP ID: ENSP00000395592
MGKRLDQPQMYPQYTYYYPHYLQTKSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSKP

SEQ ID NO: 75436 - protein, 421 aa, Homo sapiens
  Payload ID: 14904
  Gene Symbol: RBMS3
  Gene Name: RNA binding motif, single stranded interacting protein 3
  Uniprot ID: Q6XE24
  ENSP ID: ENSP00000397926
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSKP

SEQ ID NO: 75437 - protein, 433 aa, Homo sapiens
  Payload ID: 14904
  Gene Symbol: RBMS3
  Gene Name: RNA binding motif, single stranded interacting protein 3
  Uniprot ID: Q6XE24
  ENSP ID: ENSP00000400519
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEVLRGRTVPRQNREAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 75438 - protein, 305 aa, Homo sapiens
  Payload ID: 14905
  Gene Symbol: RNPS1
  Gene Name: RNA binding protein S1, serine-rich domain
  Uniprot ID: Q15287
  ENSP ID: ENSP00000301730
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 75439 - protein, 305 aa, Homo sapiens; identical to SEQ ID NO: 75438
  Payload ID: 14905
  Gene Symbol: RNPS1
  Gene Name: RNA binding protein S1, serine-rich domain
  Uniprot ID: Q15287
  ENSP ID: ENSP00000315859

SEQ ID NO: 75440 - protein, 305 aa, Homo sapiens; identical to SEQ ID NO: 75438
  Payload ID: 14905
  Gene Symbol: RNPS1
  Gene Name: RNA binding protein S1, serine-rich domain
  Uniprot ID: Q15287
  ENSP ID: ENSP00000380275

SEQ ID NO: 75441 - protein, 284 aa, Homo sapiens
  Payload ID: 14905
  Gene Symbol: RNPS1
  Gene Name: RNA binding protein S1, serine-rich domain
  ENSP ID: ENSP00000454461
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVR

SEQ ID NO: 75442 - protein, 257 aa, Homo sapiens
  Payload ID: 14905
  Gene Symbol: RNPS1
  Gene Name: RNA binding protein S1, serine-rich domain
  ENSP ID: ENSP00000454513
MAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGPAPRGAGPPCAGDHGPRAAAATGAAPAPTPPDKQATEALAPVTYTPPSSVLSLF

SEQ ID NO: 75443 - protein, 85 aa, Homo sapiens
  Payload ID: 14905
  Gene Symbol: RNPS1
  Gene Name: RNA binding protein S1, serine-rich domain
  ENSP ID: ENSP00000454867
MDLSGVKKKSLLGVKENNKKSSTRAPSPTKRKDRSDEKSKDRSKDKGATKESSEKDRGRDKTRKRRSASSGSSSTRSRSSSTSSS

SEQ ID NO: 75444 - protein, 156 aa, Homo sapiens
  Payload ID: 14905
  Gene Symbol: RNPS1
  Gene Name: RNA binding protein S1, serine-rich domain
  ENSP ID: ENSP00000455013
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPNPNHLKEMKRRGKGGAHLLSPPKCTLGDSPGM

SEQ ID NO: 75445 - protein, 98 aa, Homo sapiens
  Payload ID: 14905
  Gene Symbol: RNPS1
  Gene Name: RNA binding protein S1, serine-rich domain
  ENSP ID: ENSP00000455195
MDLSGVKKKSLLGVKENNKKSSTRAPSPTKRKDRSDEKSKDRSKDKGATKESSEKDRGRDKTRKRRSASSGSSSLGPARLPAQAPAPALAQAVAPALP

SEQ ID NO: 75446 - protein, 128 aa, Homo sapiens
  Payload ID: 14905
  Gene Symbol: RNPS1
  Gene Name: RNA binding protein S1, serine-rich domain
  ENSP ID: ENSP00000455306
MEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 75447 - protein, 128 aa, Homo sapiens; identical to SEQ ID NO: 75446
  Payload ID: 14905
  Gene Symbol: RNPS1
  Gene Name: RNA binding protein S1, serine-rich domain
  ENSP ID: ENSP00000455379

SEQ ID NO: 75448 - protein, 29 aa, Homo sapiens
  Payload ID: 14905
  Gene Symbol: RNPS1
  Gene Name: RNA binding protein S1, serine-rich domain
  ENSP ID: ENSP00000456283
MDLSGVKKKSLLGVKENNKKSSTRAPSPT

SEQ ID NO: 75449 - protein, 282 aa, Homo sapiens
  Payload ID: 14905
  Gene Symbol: RNPS1
  Gene Name: RNA binding protein S1, serine-rich domain
  Uniprot ID: Q15287
  ENSP ID: ENSP00000456352
MAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 75450 - protein, 302 aa, Homo sapiens
  Payload ID: 14905
  Gene Symbol: RNPS1
  Gene Name: RNA binding protein S1, serine-rich domain
  ENSP ID: ENSP00000457110
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSN

SEQ ID NO: 75451 - protein, 127 aa, Homo sapiens
  Payload ID: 14905
  Gene Symbol: RNPS1
  Gene Name: RNA binding protein S1, serine-rich domain
  ENSP ID: ENSP00000457296
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPS

SEQ ID NO: 75452 - protein, 45 aa, Homo sapiens
  Payload ID: 14905
  Gene Symbol: RNPS1
  Gene Name: RNA binding protein S1, serine-rich domain
  ENSP ID: ENSP00000457338
MDLSGVKKKSLLGVKENNKKSSTRAPSPTKRKDRSDEKSKDRSKD

SEQ ID NO: 75453 - protein, 150 aa, Homo sapiens
  Payload ID: 14905
  Gene Symbol: RNPS1
  Gene Name: RNA binding protein S1, serine-rich domain
  ENSP ID: ENSP00000457378
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKE

SEQ ID NO: 75454 - protein, 139 aa, Homo sapiens
  Payload ID: 14905
  Gene Symbol: RNPS1
  Gene Name: RNA binding protein S1, serine-rich domain
  ENSP ID: ENSP00000457618
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRS

SEQ ID NO: 75455 - protein, 169 aa, Homo sapiens
  Payload ID: 14905
  Gene Symbol: RNPS1
  Gene Name: RNA binding protein S1, serine-rich domain
  ENSP ID: ENSP00000457690
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLT

SEQ ID NO: 75456 - protein, 305 aa, Homo sapiens; identical to SEQ ID NO: 75438
  Payload ID: 14905
  Gene Symbol: RNPS1
  Gene Name: RNA binding protein S1, serine-rich domain
  Uniprot ID: Q15287
  ENSP ID: ENSP00000457723

SEQ ID NO: 75457 - protein, 305 aa, Homo sapiens; identical to SEQ ID NO: 75438
  Payload ID: 14905
  Gene Symbol: RNPS1
  Gene Name: RNA binding protein S1, serine-rich domain
  Uniprot ID: Q15287
  ENSP ID: ENSP00000457820

SEQ ID NO: 75458 - protein, 211 aa, Homo sapiens
  Payload ID: 14905
  Gene Symbol: RNPS1
  Gene Name: RNA binding protein S1, serine-rich domain
  ENSP ID: ENSP00000457987
MDLSGVKKKSLLGVKENNKKSSTSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 75459 - protein, 204 aa, Homo sapiens
  Payload ID: 14906
  Gene Symbol: RBPMS
  Gene Name: RNA binding protein with multiple splicing
  Uniprot ID: Q93062
  ENSP ID: ENSP00000287771
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQLCEGQTVRRSHPLSAPSPDSASLAWFPV

SEQ ID NO: 75460 - protein, 196 aa, Homo sapiens
  Payload ID: 14906
  Gene Symbol: RBPMS
  Gene Name: RNA binding protein with multiple splicing
  Uniprot ID: Q93062
  ENSP ID: ENSP00000318102
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQMRWLPPSEATSQGWKSRQFC

SEQ ID NO: 75461 - protein, 219 aa, Homo sapiens
  Payload ID: 14906
  Gene Symbol: RBPMS
  Gene Name: RNA binding protein with multiple splicing
  Uniprot ID: Q93062
  ENSP ID: ENSP00000340176
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 75462 - protein, 196 aa, Homo sapiens; identical to SEQ ID NO: 75460
  Payload ID: 14906
  Gene Symbol: RBPMS
  Gene Name: RNA binding protein with multiple splicing
  Uniprot ID: Q93062
  ENSP ID: ENSP00000380486

SEQ ID NO: 75463 - protein, 115 aa, Homo sapiens
  Payload ID: 14906
  Gene Symbol: RBPMS
  Gene Name: RNA binding protein with multiple splicing
  ENSP ID: ENSP00000427896
MAKNKLVGTPNPSTPLPNTVPQFIAREPYELTVPALYPSSPEVWAPYPLYPAELAPALPPPAFTYPASLHAQCFSPEAKPNTPVFCPLLQQIRFVSGNVFVTYQPTADQQRELPC

SEQ ID NO: 75464 - protein, 224 aa, Homo sapiens
  Payload ID: 14906
  Gene Symbol: RBPMS
  Gene Name: RNA binding protein with multiple splicing
  ENSP ID: ENSP00000428675
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQVIDTHRPGLHSLHHQSFQTWFPRAHHTTNTYPANRSTLKRLMIPSKSS

SEQ ID NO: 75465 - protein, 49 aa, Homo sapiens
  Payload ID: 14906
  Gene Symbol: RBPMS
  Gene Name: RNA binding protein with multiple splicing
  ENSP ID: ENSP00000429086
MAKNKLVGTPNPSTPLPNTVPQFIAREPYELTVPALYPSSPEVWAPYPL

SEQ ID NO: 75466 - protein, 115 aa, Homo sapiens; identical to SEQ ID NO: 75463
  Payload ID: 14906
  Gene Symbol: RBPMS
  Gene Name: RNA binding protein with multiple splicing
  ENSP ID: ENSP00000430342

SEQ ID NO: 75467 - protein, 119 aa, Homo sapiens
  Payload ID: 14906
  Gene Symbol: RBPMS
  Gene Name: RNA binding protein with multiple splicing
  ENSP ID: ENSP00000430370
  MOD_RES (1)..(1): Any amino acid
XLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPLGGANEHGERQ

SEQ ID NO: 75468 - protein, 120 aa, Homo sapiens
  Payload ID: 14906
  Gene Symbol: RBPMS
  Gene Name: RNA binding protein with multiple splicing
  ENSP ID: ENSP00000430638
MAKNKLVGTPNPSTPLPNTVPQFIAREPYELTVPALYPSSPEVWAPYPLYPAELAPALPPPAFTYPASLHAQVIDTHRPGLHSLHHQSFQTWFPRAHHTTNTYPANRSTLKRLMIPSKSS

SEQ ID NO: 75469 - protein, 113 aa, Homo sapiens
  Payload ID: 14906
  Gene Symbol: RBPMS
  Gene Name: RNA binding protein with multiple splicing
  ENSP ID: ENSP00000430893
SFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQETL

SEQ ID NO: 75470 - protein, 209 aa, Homo sapiens
  Payload ID: 14907
  Gene Symbol: RBPMS2
  Gene Name: RNA binding protein with multiple splicing 2
  Uniprot ID: Q6ZRY4
  ENSP ID: ENSP00000300069
MSNLKPDGEHGGSTGTGSGAGSGGALEEEVRTLFVSGLPVDIKPRELYLLFRPFKGYEGSLIKLTARQPVGFVIFDSRAGAEAAKNALNGIRFDPENPQTLRLEFAKANTKMAKSKLMATPNPSNVHPALGAHFIARDPYDLMGAALIPASPEAWAPYPLYTTELTPAISHAAFTYPTATAAAAALHAQVRWYPSSDTTQQGWKYRQFC

SEQ ID NO: 75471 - protein, 98 aa, Homo sapiens
  Payload ID: 14907
  Gene Symbol: RBPMS2
  Gene Name: RNA binding protein with multiple splicing 2
  Uniprot ID: Q6ZRY4
  ENSP ID: ENSP00000456720
MAKSKLMATPNPSNVHPALGAHFIARDPYDLMGAALIPASPEAWAPYPLYTTELTPAISHAAFTYPTATAAAAALHAQVRWYPSSDTTQQGWKYRQFC

SEQ ID NO: 75472 - protein, 418 aa, Homo sapiens
  Payload ID: 14908
  Gene Symbol: RBFOX1
  Gene Name: RNA binding protein, fox-1 homolog (C. elegans) 1
  Uniprot ID: Q9NWB1
  ENSP ID: ENSP00000309117
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 75473 - protein, 402 aa, Homo sapiens
  Payload ID: 14908
  Gene Symbol: RBFOX1
  Gene Name: RNA binding protein, fox-1 homolog (C. elegans) 1
  ENSP ID: ENSP00000344196
MIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 75474 - protein, 395 aa, Homo sapiens
  Payload ID: 14908
  Gene Symbol: RBFOX1
  Gene Name: RNA binding protein, fox-1 homolog (C. elegans) 1
  Uniprot ID: Q9NWB1
  ENSP ID: ENSP00000347855
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDRNQFVFVAADEISCNTSAVTDEFMLPTPTTTHLLQPPPTALVP

SEQ ID NO: 75475 - protein, 425 aa, Homo sapiens
  Payload ID: 14908
  Gene Symbol: RBFOX1
  Gene Name: RNA binding protein, fox-1 homolog (C. elegans) 1
  ENSP ID: ENSP00000391269
METGQRTHASGTYSFLDRTQHSDIKADCNTCVEIEDRKVSRQQMNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMPQGSSPSTDFRGAKLHTSRPLLSGS

SEQ ID NO: 75476 - protein, 392 aa, Homo sapiens
  Payload ID: 14908
  Gene Symbol: RBFOX1
  Gene Name: RNA binding protein, fox-1 homolog (C. elegans) 1
  Uniprot ID: Q9NWB1
  ENSP ID: ENSP00000402745
MLASQGVLLHPYGVPMIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQEPVYGNKLLQGGYAAYRYAQPTPATAAAYSDSYGRVYAADPYHHALAPAPTYGVGAMASIYRGGYNRFAPY

SEQ ID NO: 75477 - protein, 380 aa, Homo sapiens
  Payload ID: 14908
  Gene Symbol: RBFOX1
  Gene Name: RNA binding protein, fox-1 homolog (C. elegans) 1
  ENSP ID: ENSP00000438768
MKSWQLIAVVGDALQDIKADCNTCVEIEDRKVSRQQMNCEREQLRGNQEAAAAPDTMAQPYASAQFAPPQNGIPAEYTAPHPHPAPEYTGQTTVPEHTLNLYPPAQTHSEQSPADTSAQTVSGTATQFGKILDVEIIFNERGSKVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDRNQFVFVAADEISCNTSAVTDEFMLPTPTTTHLLQPPPTALVPCPKVPAPAQTSEELSCTLPGLCCQAAENLTASPPLLQFMFKVIVAQERK

SEQ ID NO: 75478 - protein, 466 aa, Homo sapiens
  Payload ID: 14908
  Gene Symbol: RBFOX1
  Gene Name: RNA binding protein, fox-1 homolog (C. elegans) 1
  ENSP ID: ENSP00000446842
METGQRTHASGTYSFLDRTQHSDIKADCNTCVEIEDRKVSRQQMNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDRNQFVFVAADEISCNTSAVTDEFMLPTPTTTHLLQPPPTALVPCPKVPAPAQTSEELSCTLPGLCCQAAENLTASPPLLQFMFKVIVAQERK

SEQ ID NO: 75479 - protein, 263 aa, Homo sapiens
  Payload ID: 14908
  Gene Symbol: RBFOX1
  Gene Name: RNA binding protein, fox-1 homolog (C. elegans) 1
  ENSP ID: ENSP00000447281
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATA

SEQ ID NO: 75480 - protein, 397 aa, Homo sapiens
  Payload ID: 14908
  Gene Symbol: RBFOX1
  Gene Name: RNA binding protein, fox-1 homolog (C. elegans) 1
  Uniprot ID: Q9NWB1
  ENSP ID: ENSP00000447717
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 75481 - protein, 370 aa, Homo sapiens
  Payload ID: 14908
  Gene Symbol: RBFOX1
  Gene Name: RNA binding protein, fox-1 homolog (C. elegans) 1
  Uniprot ID: Q9NWB1
  ENSP ID: ENSP00000447753
MNCEREQLRGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAVPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 75482 - protein, 391 aa, Homo sapiens
  Payload ID: 14908
  Gene Symbol: RBFOX1
  Gene Name: RNA binding protein, fox-1 homolog (C. elegans) 1
  ENSP ID: ENSP00000448496
MKSWQLIAVVGDALQDIKADCNTCVEIEDRKVSRQQMNCEREQLRGNQEAAAAPDTMAQPYASAQFAPPQNGIPAEYTAPHPHPAPEYTGQTTVPEHTLNLYPPAQTHSEQSPADTSAQTVSGTATTDDAAPTDGQPQTQPSENTENKSQPKRLHVSNIPFRFRDPDLRQMFGGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATAAAAYRGAHLRGRGRTVYNTFRAAAPPPPIPAYGGVVYQDGFYGADIYGGYAAYRYAQPTPATAAAYSDRNQFVFVAADEISCNTSAVTDEFMLPTPTTTHLLQPPPTALVP

SEQ ID NO: 75483 - protein, 397 aa, Homo sapiens; identical to SEQ ID NO: 75480
  Payload ID: 14908
  Gene Symbol: RBFOX1
  Gene Name: RNA binding protein, fox-1 homolog (C. elegans) 1
  Uniprot ID: Q9NWB1
  ENSP ID: ENSP00000450031

SEQ ID NO: 75484 - protein, 262 aa, Homo sapiens
  Payload ID: 14908
  Gene Symbol: RBFOX1
  Gene Name: RNA binding protein, fox-1 homolog (C. elegans) 1
  ENSP ID: ENSP00000450402
MNCEREQLRGNQEAAAAPDTMAQPYASAQFAPPQNGIPAEYTAPHPHPAPEYTGQTTVPEHTLNLYPPAQTHSEQSPADTSAQTVSGTATTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAGTVLLCQANQEGSSMYSAPSSLVYTSAMPGFPYPAATA

SEQ ID NO: 75485 - protein, 74 aa, Homo sapiens
  Payload ID: 14908
  Gene Symbol: RBFOX1
  Gene Name: RNA binding protein, fox-1 homolog (C. elegans) 1
  ENSP ID: ENSP00000454250
  MOD_RES (1)..(1): Any amino acid
XHLRGRGRTVYNTFRAAAPPPPIPAYGGVVMLHTATPSLPLPLPLPTVTVTDEFMLPTPTTTHLLQPPPTALVP

SEQ ID NO: 75486 - protein, 189 aa, Homo sapiens
  Payload ID: 14908
  Gene Symbol: RBFOX1
  Gene Name: RNA binding protein, fox-1 homolog (C. elegans) 1
  ENSP ID: ENSP00000458748
MEEKGSRMVQQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIE

SEQ ID NO: 75487 - protein, 375 aa, Homo sapiens
  Payload ID: 14908
  Gene Symbol: RBFOX1
  Gene Name: RNA binding protein, fox-1 homolog (C. elegans) 1
  ENSP ID: ENSP00000484837
MIVPAAPYLPGLIQGNQEAAAAPDTMAQPYASAQFAPPQNGIPAEYTAPHPHPAPEYTGQTTVPEHTLNLYPPAQTHSEQSPADTSAQTVSGTATQTDDAAPTDGQPQTQPSENTENKSQPKRLHVSNIPFRFRDPDLRQMFGQFGKILDVEIIFNERGSKGFGFVTFENSADADRAREKLHGTVVEGRKIEVNNATARVMTNKKTVNPYTNGWKLNPVVGAVYSPEFYAVPGFPYPAATAAAAYRGAHLRGRGRTVYNTFRAAAPPPPIPAYGGVVYQDGFYGADIYGGYAAYRYAQPTPATAAAYSDSYGRVYAADPYHHALAPAPTYGVGAMNAFAPLTDAKTRSHADDVGLVLSSLQASIYRGGYNRFAPY

SEQ ID NO: 75488 - protein, 358 aa, Homo sapiens
  Payload ID: 14909
  Gene Symbol: RBFOX2
  Gene Name: RNA binding protein, fox-1 homolog (C. elegans) 2
  Uniprot ID: O43251
  ENSP ID: ENSP00000262829
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 75489 - protein, 370 aa, Homo sapiens
  Payload ID: 14909
  Gene Symbol: RBFOX2
  Gene Name: RNA binding protein, fox-1 homolog (C. elegans) 2
  ENSP ID: ENSP00000352328
MVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYIESANCFRSNRVDMQPTDMHSLLLQPQPPLLQPLQPLTVTVMAGCTQPTPTMPLPLPLAMELALWRVYTEVATADLPPTEVT

SEQ ID NO: 75490 - protein, 357 aa, Homo sapiens
  Payload ID: 14909
  Gene Symbol: RBFOX2
  Gene Name: RNA binding protein, fox-1 homolog (C. elegans) 2
  ENSP ID: ENSP00000380470
MVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 75491 - protein, 128 aa, Homo sapiens
  Payload ID: 14909
  Gene Symbol: RBFOX2
  Gene Name: RNA binding protein, fox-1 homolog (C. elegans) 2
  ENSP ID: ENSP00000380472
MVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGFGKILDVEIIFNERGS

SEQ ID NO: 75492 - protein, 367 aa, Homo sapiens
  Payload ID: 14909
  Gene Symbol: RBFOX2
  Gene Name: RNA binding protein, fox-1 homolog (C. elegans) 2
  Uniprot ID: O43251
  ENSP ID: ENSP00000384944
MEKKKMVTQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 75493 - protein, 200 aa, Homo sapiens
  Payload ID: 14909
  Gene Symbol: RBFOX2
  Gene Name: RNA binding protein, fox-1 homolog (C. elegans) 2
  ENSP ID: ENSP00000386177
MSSDSMDQPRNPCENEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEG

SEQ ID NO: 75494 - protein, 380 aa, Homo sapiens
  Payload ID: 14909
  Gene Symbol: RBFOX2
  Gene Name: RNA binding protein, fox-1 homolog (C. elegans) 2
  Uniprot ID: O43251
  ENSP ID: ENSP00000391670
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 75495 - protein, 376 aa, Homo sapiens
  Payload ID: 14909
  Gene Symbol: RBFOX2
  Gene Name: RNA binding protein, fox-1 homolog (C. elegans) 2
  Uniprot ID: O43251
  ENSP ID: ENSP00000405651
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 75496 - protein, 370 aa, Homo sapiens
  Payload ID: 14909
  Gene Symbol: RBFOX2
  Gene Name: RNA binding protein, fox-1 homolog (C. elegans) 2
  Uniprot ID: O43251
  ENSP ID: ENSP00000407855
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 75497 - protein, 451 aa, Homo sapiens
  Payload ID: 14909
  Gene Symbol: RBFOX2
  Gene Name: RNA binding protein, fox-1 homolog (C. elegans) 2
  Uniprot ID: O43251
  ENSP ID: ENSP00000413035
MAEGAQPHQPPQLGPGAAARGMKRESELELPVPGAGGDGADPGLSKRPRTEEAAADGGGGMQNEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 75498 - protein, 230 aa, Homo sapiens
  Payload ID: 14909
  Gene Symbol: RBFOX2
  Gene Name: RNA binding protein, fox-1 homolog (C. elegans) 2
  ENSP ID: ENSP00000474464
  MOD_RES (1)..(1): Any amino acid
XSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGIVLQEPIISAKIPQGGYAAYRYAQPATATAATAAAAAAAAYSDGYGRVYTADPYHALAPAASYGVGAVASLYRGGYSRFAPY

SEQ ID NO: 75499 - protein, 234 aa, Homo sapiens
  Payload ID: 14909
  Gene Symbol: RBFOX2
  Gene Name: RNA binding protein, fox-1 homolog (C. elegans) 2
  ENSP ID: ENSP00000475142
MVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGF

SEQ ID NO: 75500 - protein, 380 aa, Homo sapiens; identical to SEQ ID NO: 75494
  Payload ID: 14909
  Gene Symbol: RBFOX2
  Gene Name: RNA binding protein, fox-1 homolog (C. elegans) 2
  Uniprot ID: O43251
  ENSP ID: ENSP00000479761

SEQ ID NO: 75501 - protein, 367 aa, Homo sapiens; identical to SEQ ID NO: 75492
  Payload ID: 14909
  Gene Symbol: RBFOX2
  Gene Name: RNA binding protein, fox-1 homolog (C. elegans) 2
  Uniprot ID: O43251
  ENSP ID: ENSP00000482053

SEQ ID NO: 75502 - protein, 358 aa, Homo sapiens; identical to SEQ ID NO: 75488
  Payload ID: 14909
  Gene Symbol: RBFOX2
  Gene Name: RNA binding protein, fox-1 homolog (C. elegans) 2
  Uniprot ID: O43251
  ENSP ID: ENSP00000485711

SEQ ID NO: 75503 - protein, 357 aa, Homo sapiens; identical to SEQ ID NO: 75490
  Payload ID: 14909
  Gene Symbol: RBFOX2
  Gene Name: RNA binding protein, fox-1 homolog (C. elegans) 2
  ENSP ID: ENSP00000485961

SEQ ID NO: 75504 - protein, 370 aa, Homo sapiens; identical to SEQ ID NO: 75496
  Payload ID: 14909
  Gene Symbol: RBFOX2
  Gene Name: RNA binding protein, fox-1 homolog (C. elegans) 2
  Uniprot ID: O43251
  ENSP ID: ENSP00000485984

SEQ ID NO: 75505 - protein, 234 aa, Homo sapiens; identical to SEQ ID NO: 75499
  Payload ID: 14909
  Gene Symbol: RBFOX2
  Gene Name: RNA binding protein, fox-1 homolog (C. elegans) 2
  ENSP ID: ENSP00000486468

SEQ ID NO: 75506 - protein, 389 aa, Homo sapiens
  Payload ID: 14909
  Gene Symbol: RBFOX2
  Gene Name: RNA binding protein, fox-1 homolog (C. elegans) 2
  ENSP ID: ENSP00000486570
NEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 75507 - protein, 227 aa, Homo sapiens
  Payload ID: 14909
  Gene Symbol: RBFOX2
  Gene Name: RNA binding protein, fox-1 homolog (C. elegans) 2
  ENSP ID: ENSP00000486646
GFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGIVLQEPIISAKIPQGGYAAYRYAQPATATAATAAAAAAAAYSDGYGRVYTADPYHALAPAASYGVGAVASLYRGGYSRFAPY

SEQ ID NO: 75508 - protein, 128 aa, Homo sapiens; identical to SEQ ID NO: 75491
  Payload ID: 14909
  Gene Symbol: RBFOX2
  Gene Name: RNA binding protein, fox-1 homolog (C. elegans) 2
  ENSP ID: ENSP00000486659

SEQ ID NO: 75509 - protein, 370 aa, Homo sapiens; identical to SEQ ID NO: 75489
  Payload ID: 14909
  Gene Symbol: RBFOX2
  Gene Name: RNA binding protein, fox-1 homolog (C. elegans) 2
  ENSP ID: ENSP00000487328

SEQ ID NO: 75510 - protein, 376 aa, Homo sapiens; identical to SEQ ID NO: 75495
  Payload ID: 14909
  Gene Symbol: RBFOX2
  Gene Name: RNA binding protein, fox-1 homolog (C. elegans) 2
  Uniprot ID: O43251
  ENSP ID: ENSP00000487477

SEQ ID NO: 75511 - protein, 186 aa, Homo sapiens
  Payload ID: 14909
  Gene Symbol: RBFOX2
  Gene Name: RNA binding protein, fox-1 homolog (C. elegans) 2
  ENSP ID: ENSP00000487500
NEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEG

SEQ ID NO: 75512 - protein, 325 aa, Homo sapiens
  Payload ID: 14910
  Gene Symbol: RBFOX3
  Gene Name: RNA binding protein, fox-1 homolog (C. elegans) 3
  Uniprot ID: A6NFN3
  ENSP ID: ENSP00000462007
MAQPYPPAQYPPPPQNGIPAEYAPPPPHPTQDYSGQTPVPTEHGMTLYTPAQTHPEQPGSEASTQPIAGTQTVPQTDEAAQTDSQPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTMVRSPGPPSPGCQS

SEQ ID NO: 75513 - protein, 312 aa, Homo sapiens
  Payload ID: 14910
  Gene Symbol: RBFOX3
  Gene Name: RNA binding protein, fox-1 homolog (C. elegans) 3
  Uniprot ID: A6NFN3
  ENSP ID: ENSP00000463653
MAQPYPPAQYPPPPQNGIPAEYAPPPPHPTQDYSGQTPVPTEHGMTLYTPAQTHPEQPGSEASTQPIAGTQTVPQTDEAAQTDSQPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTM

SEQ ID NO: 75514 - protein, 328 aa, Homo sapiens
  Payload ID: 14910
  Gene Symbol: RBFOX3
  Gene Name: RNA binding protein, fox-1 homolog (C. elegans) 3
  ENSP ID: ENSP00000463964
MAQPYPPAQYPPPPQNGIPAEYAPPPPHPTQDYSGQTPVPTEHGMTLYTPAQTHPEQPGSEASTQPIAGTQTVPQTDEAAQTDSQPLHPSDPTEKQQPKRLHVSNIPFRFRDPDLRQMFGQFGKILDVEIIFNERGSKVNNATARVMTNKKTGNPYTNGWKLNPVVGAVYGPEFYAVTGFPYPTTGTAVAYRGAHLRGRGRAVYNTFRAAPPPPPIPTYGAALEQTLVKMPVPWAGLAPCPLPPQQTPEPAYPTSPAFPPLSCPFASRVVYQDGFYGAEIYGGYAAYRYAQPAAAAAAYSDSYGRVYAAADPYHHTIGPAATYSIGTM

SEQ ID NO: 75515 - protein, 358 aa, Homo sapiens
  Payload ID: 14910
  Gene Symbol: RBFOX3
  Gene Name: RNA binding protein, fox-1 homolog (C. elegans) 3
  ENSP ID: ENSP00000464186
MAQPYPPAQYPPPPQNGIPAEYAPPPPHPTQDYSGQTPVPTEHGMTLYTPAQTHPEQPGSEASTQPIAGTQTVPTDEAAQTDSQPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAALEQTLVKMPVPWAGLAPCPLPPQQTPEPAYPTSPAFPPLSCPFASRVVYQDGFYGAEIYGGYAAYRYAQPAAAAAAYSDSYGRVYAAADPYHHTIGPAATYSIGTM

SEQ ID NO: 75516 - protein, 4 aa, Homo sapiens
  Payload ID: 14910
  Gene Symbol: RBFOX3
  Gene Name: RNA binding protein, fox-1 homolog (C. elegans) 3
  ENSP ID: ENSP00000464946
MAQP

SEQ ID NO: 75517 - protein, 75 aa, Homo sapiens
  Payload ID: 14910
  Gene Symbol: RBFOX3
  Gene Name: RNA binding protein, fox-1 homolog (C. elegans) 3
  ENSP ID: ENSP00000465367
  MOD_RES (1)..(1): Any amino acid
XVVYQDGFYGAEIYGGYAAYRYAQPAAAAAAYSDSYGRVYAAADPYHHTIGPAATYSIGTMASLCRGGYSRFTPY

SEQ ID NO: 75518 - protein, 52 aa, Homo sapiens
  Payload ID: 14910
  Gene Symbol: RBFOX3
  Gene Name: RNA binding protein, fox-1 homolog (C. elegans) 3
  ENSP ID: ENSP00000467872
MLCSMANSGCLLLSNSGSMLPHSVPCPPAFLYLQQSDQDATAPPEAMAQPYP

SEQ ID NO: 75519 - protein, 131 aa, Homo sapiens
  Payload ID: 14910
  Gene Symbol: RBFOX3
  Gene Name: RNA binding protein, fox-1 homolog (C. elegans) 3
  ENSP ID: ENSP00000468693
  MOD_RES (1)..(1): Any amino acid
XVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTMASLCRGGYSRFTPY

SEQ ID NO: 75520 - protein, 237 aa, Homo sapiens
  Payload ID: 14911
  Gene Symbol: REXO2
  Gene Name: RNA exonuclease 2
  Uniprot ID: Q9Y3B8
  ENSP ID: ENSP00000265881
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 75521 - protein, 67 aa, Homo sapiens
  Payload ID: 14911
  Gene Symbol: REXO2
  Gene Name: RNA exonuclease 2
  ENSP ID: ENSP00000437380
IEKDQIIEMACLITDSDLNILAEGPNLIIKQPDELLDSMSDWCKEHHGKEIQFMKIRSFLTNTCPSS

SEQ ID NO: 75522 - protein, 85 aa, Homo sapiens
  Payload ID: 14911
  Gene Symbol: REXO2
  Gene Name: RNA exonuclease 2
  ENSP ID: ENSP00000437460
MLGGSLGSRLLRGVGGSHGRFGARGVREGGAAMAAGESMAQRMVWVDLEMTGLDIEKDQIIEMACLITDSDLNILAEVKEVRTYF

SEQ ID NO: 75523 - protein, 222 aa, Homo sapiens
  Payload ID: 14911
  Gene Symbol: REXO2
  Gene Name: RNA exonuclease 2
  ENSP ID: ENSP00000440665
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 75524 - protein, 90 aa, Homo sapiens
  Payload ID: 14911
  Gene Symbol: REXO2
  Gene Name: RNA exonuclease 2
  ENSP ID: ENSP00000441639
  MOD_RES (1)..(1): Any amino acid
XGSRLLRGVGGSHGRFGARGVREGGAAMAAGESMAQRMVWVDLEMTGLDIEKDQIIEMACLITDSDLNILAEEIQFMKIRSFLTNTCPSS

SEQ ID NO: 75525 - protein, 188 aa, Homo sapiens
  Payload ID: 14911
  Gene Symbol: REXO2
  Gene Name: RNA exonuclease 2
  ENSP ID: ENSP00000441844
MTGLDIEKDQIIEMACLITDSDLNILAEGPNLIIKQPDELLDSMSDWCKEHHGKSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 75526 - protein, 67 aa, Homo sapiens
  Payload ID: 14911
  Gene Symbol: REXO2
  Gene Name: RNA exonuclease 2
  ENSP ID: ENSP00000442380
MLGGSLGSRLLRGVGGSHGRFGARGVREGGAAMAAGESMAQRMVWVDLEEIQFMKIRSFLTNTCPSS

SEQ ID NO: 75527 - protein, 121 aa, Homo sapiens
  Payload ID: 14911
  Gene Symbol: REXO2
  Gene Name: RNA exonuclease 2
  ENSP ID: ENSP00000442703
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKEIQFMKIRSFLTNTCPSS

SEQ ID NO: 75528 - protein, 79 aa, Homo sapiens
  Payload ID: 14911
  Gene Symbol: REXO2
  Gene Name: RNA exonuclease 2
  ENSP ID: ENSP00000443842
MLGGSLGSRLLRGVGGSHGRFGARGVREGGAAMAAGESMAQRMVWVDLEMTGLDIEKDQIIEMACLITDSDLNILAEGT

SEQ ID NO: 75529 - protein, 192 aa, Homo sapiens
  Payload ID: 14911
  Gene Symbol: REXO2
  Gene Name: RNA exonuclease 2
  ENSP ID: ENSP00000444421
  MOD_RES (1)..(1): Any amino acid
XGRFGARGVREGGAAMAAGESMAQRMVWVDLEGPNLIIKQPDELLDSMSDWCKEHHGKSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 75530 - protein, 237 aa, Homo sapiens; identical to SEQ ID NO: 75520
  Payload ID: 14911
  Gene Symbol: REXO2
  Gene Name: RNA exonuclease 2
  Uniprot ID: Q9Y3B8
  ENSP ID: ENSP00000480535

SEQ ID NO: 75531 - protein, 574 aa, Homo sapiens
  Payload ID: 14912
  Gene Symbol: RNGTT
  Gene Name: RNA guanylyltransferase and 5'-phosphatase
  Uniprot ID: O60942
  ENSP ID: ENSP00000358487
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 75532 - protein, 597 aa, Homo sapiens
  Payload ID: 14912
  Gene Symbol: RNGTT
  Gene Name: RNA guanylyltransferase and 5'-phosphatase
  Uniprot ID: O60942
  ENSP ID: ENSP00000358497
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 75533 - protein, 457 aa, Homo sapiens
  Payload ID: 14912
  Gene Symbol: RNGTT
  Gene Name: RNA guanylyltransferase and 5'-phosphatase
  Uniprot ID: O60942
  ENSP ID: ENSP00000442609
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKKYKPGRCDDILKWKPPSLNSVDFRLKITRMGGEG

SEQ ID NO: 75534 - protein, 420 aa, Homo sapiens
  Payload ID: 14913
  Gene Symbol: RNMTL1
  Gene Name: RNA methyltransferase like 1
  Uniprot ID: Q9HC36
  ENSP ID: ENSP00000306080
MAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGCVDAWEPKVLRAGMGAHFRMPIINNLEWETVPNYLPPDTRVYVADNCGLYAQAEMSNKASDHGWVCDQRVMKFHKYEEEEDVETGASQDWLPHVEVQSYDSDWTEAPAAVVIGGETYGVSLESLQLAESTGGKRLLIPVVPGVDSLNSAMAASILLFEGKRQLRGRAEDLSRDRSYH

SEQ ID NO: 75535 - protein, 110 aa, Homo sapiens
  Payload ID: 14913
  Gene Symbol: RNMTL1
  Gene Name: RNA methyltransferase like 1
  ENSP ID: ENSP00000458328
MAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLRDFCQA

SEQ ID NO: 75536 - protein, 177 aa, Homo sapiens
  Payload ID: 14913
  Gene Symbol: RNMTL1
  Gene Name: RNA methyltransferase like 1
  ENSP ID: ENSP00000460957
  MOD_RES (1)..(1): Any amino acid
XPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGKDIKGQA

SEQ ID NO: 75537 - protein, 1393 aa, Homo sapiens
  Payload ID: 14914
  Gene Symbol: RPAP1
  Gene Name: RNA polymerase II associated protein 1
  Uniprot ID: Q9BWH6
  ENSP ID: ENSP00000306123
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDEDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMQRLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSDEVKAARRSMLQKTWLLADEGLRQHLLHYKLPNSTLPEGFELYSQLPPLRQHYLQRLTSTVLQNGVSET

SEQ ID NO: 75538 - protein, 1315 aa, Homo sapiens
  Payload ID: 14914
  Gene Symbol: RPAP1
  Gene Name: RNA polymerase II associated protein 1
  Uniprot ID: Q9BWH6
  ENSP ID: ENSP00000455363
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDEDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMQRLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQVLSQPSRTCKGTLHWASGAVLSLEELWKTSASSSYLLGALRGLRESMKRA

SEQ ID NO: 75539 - protein, 180 aa, Homo sapiens
  Payload ID: 14914
  Gene Symbol: RPAP1
  Gene Name: RNA polymerase II associated protein 1
  ENSP ID: ENSP00000455381
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPE

SEQ ID NO: 75540 - protein, 128 aa, Homo sapiens
  Payload ID: 14914
  Gene Symbol: RPAP1
  Gene Name: RNA polymerase II associated protein 1
  ENSP ID: ENSP00000455527
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVA

SEQ ID NO: 75541 - protein, 1128 aa, Homo sapiens
  Payload ID: 14914
  Gene Symbol: RPAP1
  Gene Name: RNA polymerase II associated protein 1
  ENSP ID: ENSP00000456207
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDEDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMQRLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPCLCPWSVTQCLLKTTWPSFSSTSGPWLLVRSAHVGAPCSMLWLWLMSIASSSLRTHRAQMRSKLPAGVCCRKHGCWQMRVSGSTSCTISFPIPRSQRALSSILSCPLCVSTTSRD

SEQ ID NO: 75542 - protein, 200 aa, Homo sapiens
  Payload ID: 14914
  Gene Symbol: RPAP1
  Gene Name: RNA polymerase II associated protein 1
  ENSP ID: ENSP00000457203
STLCYCHETTSCPGLSWEEYCCPADCAHFQLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAW

SEQ ID NO: 75543 - protein, 612 aa, Homo sapiens
  Payload ID: 14915
  Gene Symbol: RPAP2
  Gene Name: RNA polymerase II associated protein 2
  Uniprot ID: Q8IXW5
  ENSP ID: ENSP00000476948
MADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHKANSKHKDKEQTVVDVTEQLGDCKLDSQEKDATCELPLQKVNTQSSSNSTLPERLKASENSESEYSRSEITLVGISKKSAEHFKRKFAKSNQVSRSVSSSVQVCPEVGKRNLLKVLKETLIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGEETTKSQDSEEHDSTFPLIDSSSQNQIRKRIVLEKLSKVLPGLLVPLQITLGDIYTQLKNLVRTFRLTNRNIIHKPAEWTLIAMVLLSLLTPILGIQKHSQEGMVFTRFLDTLLEELHLKNEDLESLTIIFRTSCLPE

SEQ ID NO: 75544 - protein, 665 aa, Homo sapiens
  Payload ID: 14916
  Gene Symbol: RPAP3
  Gene Name: RNA polymerase II associated protein 3
  Uniprot ID: Q9H6T3
  ENSP ID: ENSP00000005386
MTSANKAIELQLQVKQNAEELQDFMRDLENWEKDIKQKDMELRRQNGVPEENLPPIRNGNFRKKKKGKAKESSKKTREENTKNRIKSYDYEAWAKLDVDRILDELDKDDSTHESLSQESESEEDGIHVDSQKALVLKEKGNKYFKQGKYDEAIDCYTKGMDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFFKEGKYERAIECYTRGIAADGANALLPANRAMAYLKIQKYEEAEKDCTQAILLDGSYSKAFARRGTARTFLGKLNEAKQDFETVLLLEPGNKQAVTELSKIKKELIEKGHWDDVFLDSTQRQNVVKPIDNPPHPGSTKPLKKVIIEETGNLIQTIDVPDSTTAAAPENNPINLANVIAATGTTSKKNSSQDDLFPTSDTPRAKVLKIEEVSDTSSLQPQASLKQDVCQSYSEKMPIEIEQKPAQFATTVLPPIPANSFQLESDFRQLKSSPDMLYQYLKQIEPSLYPKLFQKNLDPDVFNQIVKILHDFYIEKEKPLLIFEILQRLSELKRFDMAVMFMSETEKKIARALFNHIDKSGLKDSSVEELKKRYGG

SEQ ID NO: 75545 - protein, 631 aa, Homo sapiens
  Payload ID: 14916
  Gene Symbol: RPAP3
  Gene Name: RNA polymerase II associated protein 3
  Uniprot ID: Q9H6T3
  ENSP ID: ENSP00000370024
MTSANKAIELQLQVKQNAEELQDFMRDLENWEKDIKQKDMELRRQNGVPEENLPPIRNGNFRKKKKGKAKESSKKTREENTKNRIKSYDYEAWAKLDVDRILDELDKDDSTHESLSQESESEEDGIHVDSQKALVLKEKGNKYFKQGKYDEAIDCYTKGMDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFFKEGKYERAIECYTRGIAADGANALLPANRAMAYLKIQKYEEAEKDCTQAILLDGSYSKAFARRGTARTFLGKLNEAKQDFETVLLLEPGNKQAVTELSKIKKKPLKKVIIEETGNLIQTIDVPDSTTAAAPENNPINLANVIAATGTTSKKNSSQDDLFPTSDTPRAKVLKIEEVSDTSSLQPQASLKQDVCQSYSEKMPIEIEQKPAQFATTVLPPIPANSFQLESDFRQLKSSPDMLYQYLKQIEPSLYPKLFQKNLDPDVFNQIVKILHDFYIEKEKPLLIFEILQRLSELKRFDMAVMFMSETEKKIARALFNHIDKSGLKDSSVEELKKRYGG

SEQ ID NO: 75546 - protein, 506 aa, Homo sapiens
  Payload ID: 14916
  Gene Symbol: RPAP3
  Gene Name: RNA polymerase II associated protein 3
  Uniprot ID: Q9H6T3
  ENSP ID: ENSP00000401823
MDADPYNPVLPTNRASAYFRLKKFAVAESDCNLAVALNRSYTKAYSRRGAARFALQKLEEAKKDYERVLELEPNNFEATNELRKISQALASKENSYPKEADIVIKSTEGERKQIEAQQNKQQAISEKDRGNGFFKEGKYERAIECYTRGIAADGANALLPANRAMAYLKIQKYEEAEKDCTQAILLDGSYSKAFARRGTARTFLGKLNEAKQDFETVLLLEPGNKQAVTELSKIKKELIEKGHWDDVFLDSTQRQNVVKPIDNPPHPGSTKPLKKVIIEETGNLIQTIDVPDSTTAAAPENNPINLANVIAATGTTSKKNSSQDDLFPTSDTPRAKVLKIEEVSDTSSLQPQASLKQDVCQSYSEKMPIEIEQKPAQFATTVLPPIPANSFQLESDFRQLKSSPDMLYQYLKQIEPSLYPKLFQKNLDPDVFNQIVKILHDFYIEKEKPLLIFEILQRLSELKRFDMAVMFMSETEKKIARALFNHIDKSGLKDSSVEELKKRYGG

SEQ ID NO: 75547 - protein, 312 aa, Homo sapiens
  Payload ID: 14917
  Gene Symbol: RPUSD1
  Gene Name: RNA pseudouridylate synthase domain containing 1
  Uniprot ID: Q9UJJ7
  ENSP ID: ENSP00000007264
MEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 75548 - protein, 181 aa, Homo sapiens
  Payload ID: 14917
  Gene Symbol: RPUSD1
  Gene Name: RNA pseudouridylate synthase domain containing 1
  ENSP ID: ENSP00000454616
MCIEGSQGVAGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWT

SEQ ID NO: 75549 - protein, 312 aa, Homo sapiens; identical to SEQ ID NO: 75547
  Payload ID: 14917
  Gene Symbol: RPUSD1
  Gene Name: RNA pseudouridylate synthase domain containing 1
  Uniprot ID: Q9UJJ7
  ENSP ID: ENSP00000455026

SEQ ID NO: 75550 - protein, 183 aa, Homo sapiens
  Payload ID: 14917
  Gene Symbol: RPUSD1
  Gene Name: RNA pseudouridylate synthase domain containing 1
  ENSP ID: ENSP00000455862
MCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQWLSEWTLEPDS

SEQ ID NO: 75551 - protein, 168 aa, Homo sapiens
  Payload ID: 14917
  Gene Symbol: RPUSD1
  Gene Name: RNA pseudouridylate synthase domain containing 1
  ENSP ID: ENSP00000456231
MEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALLRGHIQESRVTISHAIGRNSTEGRAHTMCIEGSQGVAGCENPKPSLTDLVVLEHGLYAGDPVSKVL

SEQ ID NO: 75552 - protein, 97 aa, Homo sapiens
  Payload ID: 14917
  Gene Symbol: RPUSD1
  Gene Name: RNA pseudouridylate synthase domain containing 1
  ENSP ID: ENSP00000456545
MEPGSVENLSIVYRSRDFLVVNKHWDVRIDSKAWRETLTLQKQLRYRFPELADPDTCYGFRFCHQLDFSTSGALCVALNKAAAGSAYSCGGTSRRAG

SEQ ID NO: 75553 - protein, 173 aa, Homo sapiens
  Payload ID: 14917
  Gene Symbol: RPUSD1
  Gene Name: RNA pseudouridylate synthase domain containing 1
  ENSP ID: ENSP00000456692
MCIEGSQGCENPKPSLTDLVVLEHGLYAGDPVSKVLLKPLTGRTHQLRVHCSALGHPVVGDLTYGEVSGREDRPFRMMLHAFYLRIPTDTECVEVCTPDPFLPSLDACWSPHTLLQSLDQLVQALRATPDPDPEDRGPRPGSPSALLPGPGRPPPPPTKPPETEAQRGPCLQW

SEQ ID NO: 75554 - protein, 141 aa, Homo sapiens
  Payload ID: 14917
  Gene Symbol: RPUSD1
  Gene Name: RNA pseudouridylate synthase domain containing 1
  ENSP ID: ENSP00000457527
MEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALVRPAAGAHPGEPGNHQPCHWQEQHGGPGPHHVHRGLAGL

SEQ ID NO: 75555 - protein, 131 aa, Homo sapiens
  Payload ID: 14917
  Gene Symbol: RPUSD1
  Gene Name: RNA pseudouridylate synthase domain containing 1
  ENSP ID: ENSP00000457722
MEPGSVENLSIVYRSRDFLVVNKHWDVRIDSKAWRETLTLQKQLRYRFPELADPDTCYGFRFCHQLDFSTSGALCVALNKAAAGSAYRCFKERRVTKAYLALVVRTQSQASQISWFWNTGCTQAILSPKCC

SEQ ID NO: 75556 - protein, 178 aa, Homo sapiens
  Payload ID: 14917
  Gene Symbol: RPUSD1
  Gene Name: RNA pseudouridylate synthase domain containing 1
  ENSP ID: ENSP00000458059
  MOD_RES (1)..(1): Any amino acid
XQLDFSTSGALCVALNKAAAGSAYRCFKERRVTKAYLALLRGHIQESRVTISHAIGRNSTEGRAHTMCIEGSQGCENPKPSLTDLVVLEHGLYAGDPVSKVLLKPLTGVSGVGGVLVVTEGKLRHRATKLMLGHPEHQGRAGNKHSCVLNSTPCSLSASHLTQGPCWLLTDSLGVWLA

SEQ ID NO: 75557 - protein, 545 aa, Homo sapiens
  Payload ID: 14918
  Gene Symbol: RPUSD2
  Gene Name: RNA pseudouridylate synthase domain containing 2
  Uniprot ID: Q8IZ73
  ENSP ID: ENSP00000323288
MWLDRRGWLRVLGHWRYDLRRPSFTRTWSGDKGPMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKDNDFLRNTVHRHEPPVTAEPIRLLAENEDVVVVDKPSSIPVHPCGRFRHNTVIFILGKEHQLKELHPLHRLDRLTSGVLMFAKTAAVSERIHEQVRDRQLEKEYVCRVEGEFPTEEVTCKEPILVVSYKVGVCRVDPRGKPCETVFQRLSYNGQSSVVRCRPLTGRTHQIRVHLQFLGHPILNDPIYNSVAWGPSRGRGGYIPKTNEELLRDLVAEHQAKQSLDVLDLCEGDLSPGLTDSTAPSSELGKDDLEELAAAAQKMEEVAEAAPQELDTIALASEKAVETDVMNQETDPLCAECRLVRQDPLPQDLVMFLHALRYKGPGFEYFSPMPAWAQDDWQKD

SEQ ID NO: 75558 - protein, 484 aa, Homo sapiens
  Payload ID: 14918
  Gene Symbol: RPUSD2
  Gene Name: RNA pseudouridylate synthase domain containing 2
  Uniprot ID: Q8IZ73
  ENSP ID: ENSP00000453036
MWLDRRGWLRVLGHWRYDLRRPSFTRTWSGDKGPMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKDNDFLRNTVHRHEPPVTAEPIRLLAENEDVVVVDKPSSIPVHPCGRFRHNTVIFILGKEHQLKELHPLHRLDRLTSGVLMFAKTAAVSERIHEQVRDRQLEKEYVCRVEGEFPTEEVTCKEPILVVSYKVGVCRVDPRGKPCETVFQRLSYNGQSSVVRCRPLTGRTHQIRVHLQFLGHPILNDPIYNSVAWGPSRGRGGYIPKTNEELLRDLVAEHQAKQSLDVLDLCEGDLSPGLTDSTAPSSELGKDDLEELAAAAQKMEEVAEAAPQELDTIALASEKAVETDVMNQETDPLCAECRLVRQDPLPQDLVMFLHALRYKGPGFEYFSPMPAWAQDDWQKD

SEQ ID NO: 75559 - protein, 172 aa, Homo sapiens
  Payload ID: 14918
  Gene Symbol: RPUSD2
  Gene Name: RNA pseudouridylate synthase domain containing 2
  ENSP ID: ENSP00000480942
PMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKVES

SEQ ID NO: 75560 - protein, 351 aa, Homo sapiens
  Payload ID: 14919
  Gene Symbol: RPUSD3
  Gene Name: RNA pseudouridylate synthase domain containing 3
  Uniprot ID: Q6P087
  ENSP ID: ENSP00000373331
MRAVLAREMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 75561 - protein, 151 aa, Homo sapiens
  Payload ID: 14919
  Gene Symbol: RPUSD3
  Gene Name: RNA pseudouridylate synthase domain containing 3
  ENSP ID: ENSP00000395446
NQRAGWSAGLPLWTHMRAVLAREMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGK

SEQ ID NO: 75562 - protein, 36 aa, Homo sapiens
  Payload ID: 14919
  Gene Symbol: RPUSD3
  Gene Name: RNA pseudouridylate synthase domain containing 3
  ENSP ID: ENSP00000395492
  MOD_RES (1)..(1): Any amino acid
XEMDGRRVLGRFWSGWRRGLGVRPVPEDAGFGTEAR

SEQ ID NO: 75563 - protein, 102 aa, Homo sapiens
  Payload ID: 14919
  Gene Symbol: RPUSD3
  Gene Name: RNA pseudouridylate synthase domain containing 3
  ENSP ID: ENSP00000396405
  MOD_RES (1)..(1): Any amino acid
XVLGRFWSGWRRGLGVRPVPEDAGFGTEARTSSDVEQATGSTSDRKTRRADVVLSAARAEPVPRAQGAGASGCPSIWEVSGRGDRKLGVQASICGGETAAWG

SEQ ID NO: 75564 - protein, 336 aa, Homo sapiens
  Payload ID: 14919
  Gene Symbol: RPUSD3
  Gene Name: RNA pseudouridylate synthase domain containing 3
  Uniprot ID: Q6P087
  ENSP ID: ENSP00000398921
MRAVLAREMDGRRVLGRFWSGWRRGLGVRPVPEDAGFGTEARHQRQPRGSCQRSGPLGDQPFAGLLPKNLSREELVDALRAAVVDRKGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 75565 - protein, 280 aa, Homo sapiens
  Payload ID: 14919
  Gene Symbol: RPUSD3
  Gene Name: RNA pseudouridylate synthase domain containing 3
  ENSP ID: ENSP00000400397
  MOD_RES (1)..(1): Any amino acid
XGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLACSLLAGTTDSSSEGPIPKGHPGRCQEDSQSLSCGSHRLWLCPGPAAATDSVLQSTTGAHGTTALPCAWGPHVLCPCGHCPGPAISAAS

SEQ ID NO: 75566 - protein, 144 aa, Homo sapiens
  Payload ID: 14919
  Gene Symbol: RPUSD3
  Gene Name: RNA pseudouridylate synthase domain containing 3
  ENSP ID: ENSP00000405054
  MOD_RES (1)..(1): Any amino acid
XAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLQPTCLLLSEGWRERSWMKPSSDAST

SEQ ID NO: 75567 - protein, 212 aa, Homo sapiens
  Payload ID: 14919
  Gene Symbol: RPUSD3
  Gene Name: RNA pseudouridylate synthase domain containing 3
  ENSP ID: ENSP00000408693
MGPVVPEFSRHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTGPG

SEQ ID NO: 75568 - protein, 246 aa, Homo sapiens
  Payload ID: 14919
  Gene Symbol: RPUSD3
  Gene Name: RNA pseudouridylate synthase domain containing 3
  ENSP ID: ENSP00000415616
LAREMDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTGRSGTLASL

SEQ ID NO: 75569 - protein, 377 aa, Homo sapiens
  Payload ID: 14920
  Gene Symbol: RPUSD4
  Gene Name: RNA pseudouridylate synthase domain containing 4
  Uniprot ID: Q96CM3
  ENSP ID: ENSP00000298317
MAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWAITVHVPMPSAGVVDIPIVEKEAQGQQQHHKMTLSPSYRMDDGKMVKVRRSRNAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 75570 - protein, 346 aa, Homo sapiens
  Payload ID: 14920
  Gene Symbol: RPUSD4
  Gene Name: RNA pseudouridylate synthase domain containing 4
  Uniprot ID: Q96CM3
  ENSP ID: ENSP00000433065
MAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWAITVHVPMPSAGVVDIPIVEKEAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 75571 - protein, 176 aa, Homo sapiens
  Payload ID: 14920
  Gene Symbol: RPUSD4
  Gene Name: RNA pseudouridylate synthase domain containing 4
  ENSP ID: ENSP00000433709
MAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGAQQHSLLRPRGAPAHHWN

SEQ ID NO: 75572 - protein, 187 aa, Homo sapiens
  Payload ID: 14921
  Gene Symbol: RCL1
  Gene Name: RNA terminal phosphate cyclase-like 1
  Uniprot ID: Q9Y2P8
  ENSP ID: ENSP00000371147
MTSLTPGCRYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSKTLK

SEQ ID NO: 75573 - protein, 187 aa, Homo sapiens; identical to SEQ ID NO: 75572
  Payload ID: 14921
  Gene Symbol: RCL1
  Gene Name: RNA terminal phosphate cyclase-like 1
  Uniprot ID: Q9Y2P8
  ENSP ID: ENSP00000371149

SEQ ID NO: 75574 - protein, 175 aa, Homo sapiens
  Payload ID: 14921
  Gene Symbol: RCL1
  Gene Name: RNA terminal phosphate cyclase-like 1
  ENSP ID: ENSP00000371151
MATQAHSLSYAGCNFLRQRLVLSTLSGRPVKIRKIRARDDNPGLRDFEASFIRLLDKITNGSRIEINQTGTTLYYQPGLLYGGSVEHDCSVLRGIGYYLESLLCLAPFMKHPLKIVLRGVTNDQVDPSVSIENKPWCGFCFVSCHNPTCEKKVPYKAQFYYKCILLLLFTLRFRG

SEQ ID NO: 75575 - protein, 373 aa, Homo sapiens
  Payload ID: 14921
  Gene Symbol: RCL1
  Gene Name: RNA terminal phosphate cyclase-like 1
  Uniprot ID: Q9Y2P8
  ENSP ID: ENSP00000371169
MATQAHSLSYAGCNFLRQRLVLSTLSGRPVKIRKIRARDDNPGLRDFEASFIRLLDKITNGSRIEINQTGTTLYYQPGLLYGGSVEHDCSVLRGIGYYLESLLCLAPFMKHPLKIVLRGVTNDQVDPSVDVLKATALPLLKQFGIDGESFELKIVRRGMPPGGGGEVVFSCPVRKVLKPIQLTDPGKIKRIRGMAYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSKTLK

SEQ ID NO: 75576 - protein, 187 aa, Homo sapiens; identical to SEQ ID NO: 75572
  Payload ID: 14921
  Gene Symbol: RCL1
  Gene Name: RNA terminal phosphate cyclase-like 1
  Uniprot ID: Q9Y2P8
  ENSP ID: ENSP00000388096

SEQ ID NO: 75577 - protein, 215 aa, Homo sapiens
  Payload ID: 14921
  Gene Symbol: RCL1
  Gene Name: RNA terminal phosphate cyclase-like 1
  ENSP ID: ENSP00000412000
MPPGGGGEVVFSCPVRKVLKPIQLTDPGKIKRIRGMAYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSKTLK

SEQ ID NO: 75578 - protein, 137 aa, Homo sapiens
  Payload ID: 14921
  Gene Symbol: RCL1
  Gene Name: RNA terminal phosphate cyclase-like 1
  ENSP ID: ENSP00000413381
MTSLTPGCRYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPY

SEQ ID NO: 75579 - protein, 517 aa, Homo sapiens
  Payload ID: 14922
  Gene Symbol: RNPC3
  Gene Name: RNA-binding region (RNP1, RRM) containing 3
  Uniprot ID: Q96LT9
  ENSP ID: ENSP00000391432
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRRELEKGRISREEMETLSVFRSYEPGEPNCRIYVKNLAKHVQEKDLKYIFGRYVDFSSETQRIMFDIRLMKEGRMKGQAFIGLPNEKAAAKALKEANGYVLFGKPMVVQFARSARPKQDPKEGKRKC

SEQ ID NO: 75580 - protein, 185 aa, Homo sapiens
  Payload ID: 14922
  Gene Symbol: RNPC3
  Gene Name: RNA-binding region (RNP1, RRM) containing 3
  ENSP ID: ENSP00000431344
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQ

SEQ ID NO: 75581 - protein, 517 aa, Homo sapiens; identical to SEQ ID NO: 75579
  Payload ID: 14922
  Gene Symbol: RNPC3
  Gene Name: RNA-binding region (RNP1, RRM) containing 3
  Uniprot ID: Q96LT9
  ENSP ID: ENSP00000432886

SEQ ID NO: 75582 - protein, 18 aa, Homo sapiens
  Payload ID: 14922
  Gene Symbol: RNPC3
  Gene Name: RNA-binding region (RNP1, RRM) containing 3
  ENSP ID: ENSP00000434721
FARSARPKQDPKEGKRKC

SEQ ID NO: 75583 - protein, 182 aa, Homo sapiens
  Payload ID: 14922
  Gene Symbol: RNPC3
  Gene Name: RNA-binding region (RNP1, RRM) containing 3
  ENSP ID: ENSP00000435440
  MOD_RES (1)..(1): Any amino acid
XMELANLQPKRPKTIKQRHVRKKRKIKDMLNTPLCPSHSSLHPVLLPSDVFDQPQPVGNKRIEFHISTDMPAAFKKDLEKEQNCEEKNHGFGKIFPKPNLDITEEIKEDSDEMPSECISRRELEKGRISREEMETLSVFRSYEPGEPNCRIYVKNLAKHVQEKDLKYIFGRYVDFSSETQRI

SEQ ID NO: 75584 - protein, 138 aa, Homo sapiens
  Payload ID: 14922
  Gene Symbol: RNPC3
  Gene Name: RNA-binding region (RNP1, RRM) containing 3
  ENSP ID: ENSP00000436315
MYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSH

SEQ ID NO: 75585 - protein, 516 aa, Homo sapiens
  Payload ID: 14922
  Gene Symbol: RNPC3
  Gene Name: RNA-binding region (RNP1, RRM) containing 3
  Uniprot ID: Q96LT9
  ENSP ID: ENSP00000437278
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSLHPVLLPSDVFDQPQPVGNKRIEFHISTDMPAAFKKDLEKEQNCEEKNHDLPATEVDASNIGFGKIFPKPNLDITEEIKEDSDEMPSECISRRELEKGRISREEMETLSVFRSYEPGEPNCRIYVKNLAKHVQEKDLKYIFGRYVDFSSETQRIMFDIRLMKEGRMKGQAFIGLPNEKAAAKALKEANGYVLFGKPMVVQFARSARPKQDPKEGKRKC

SEQ ID NO: 75586 - protein, 233 aa, Homo sapiens
  Payload ID: 14923
  Gene Symbol: RNASEK-C17orf49
  Gene Name: RNASEK-C17orf49 readthrough
  ENSP ID: ENSP00000450085
  MOD_RES (1)..(1): Any amino acid
XDFENGPQNIYNLYEQVSYNCFIAAGLYLLLGGFSFCQVRLNKRKEYMVGEIFSAAGAAFTKLGELTMQLHPVADSSPAGAKWTETEIEMLRAAVKRFGDDLNHISCVIKERTVAQIKATVKRKVYEDSGIPLPAESPKKGPKKVASGVLSPPPAAPPPSSSSVPEAGGPPIKKQKADVTLSALNDSDANSDVVDIEGLGETPPAKKLNFDQDSLTLDSGLLMTSADPPLLSC

SEQ ID NO: 75587 - protein, 221 aa, Homo sapiens
  Payload ID: 14924
  Gene Symbol: RNF103-CHMP3
  Gene Name: RNF103-CHMP3 readthrough
  ENSP ID: ENSP00000392995
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAM

SEQ ID NO: 75588 - protein, 251 aa, Homo sapiens
  Payload ID: 14924
  Gene Symbol: RNF103-CHMP3
  Gene Name: RNF103-CHMP3 readthrough
  ENSP ID: ENSP00000474823
MEGELYSALKEEEASESVSSTNFSGEMHFYELVEDTKDGIWLVQVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 75589 - protein, 287 aa, Homo sapiens
  Payload ID: 14925
  Gene Symbol: ROGDI
  Gene Name: rogdi homolog
  Uniprot ID: Q9GZN7
  ENSP ID: ENSP00000322832
MATVMAATAAERAVLEEEFRWLLHDEVHAVLKQLQDILKEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKISVFSSYWSYRPF

SEQ ID NO: 75590 - protein, 121 aa, Homo sapiens
  Payload ID: 14925
  Gene Symbol: ROGDI
  Gene Name: rogdi homolog
  ENSP ID: ENSP00000464699
DVNLKMPRNNQLLHFAFREDKQWKLQQIQDARNHVSQAIYLLTSRDQSYQFKTGAEVLKRMFAPALPSDLLVNVYINLNKLCLTVYQLHALQPNSTKNFRPAGGAVLHSPGAMFGALSAWR

SEQ ID NO: 75591 - protein, 217 aa, Homo sapiens
  Payload ID: 14925
  Gene Symbol: ROGDI
  Gene Name: rogdi homolog
  ENSP ID: ENSP00000465076
  MOD_RES (1)..(1): Any amino acid
XLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKRVGLSAPGGEPRAQSGVRDPLAQRRPGLLHRLPAALPAAQGQDLRVLQLLELQTLLITAPRSLSPGRRPRPLLIP

SEQ ID NO: 75592 - protein, 68 aa, Homo sapiens
  Payload ID: 14925
  Gene Symbol: ROGDI
  Gene Name: rogdi homolog
  ENSP ID: ENSP00000465970
MATVMAATAAERAVLEEEFRWLLHDEVHAVLKQLQDILKEASLRFTLPGSGTEGPAKQENFILGSCGM

SEQ ID NO: 75593 - protein, 119 aa, Homo sapiens
  Payload ID: 14925
  Gene Symbol: ROGDI
  Gene Name: rogdi homolog
  ENSP ID: ENSP00000466529
MATVMAATAAERAVLEEEFRWLLHDEVHAVLKQLQDILKEASLRFTLPGSGTEGPAKQENFILGSCGTDQVKGVLTLQGDALSQAVSPPALSPPILPMGKSMGAPTFSLYKPCDSGRDP

SEQ ID NO: 75594 - protein, 171 aa, Homo sapiens
  Payload ID: 14925
  Gene Symbol: ROGDI
  Gene Name: rogdi homolog
  ENSP ID: ENSP00000467459
MATVMAATAAERAVLEEEFRWLLHDEVHAVLKQLQDILKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKVG

SEQ ID NO: 75595 - protein, 253 aa, Homo sapiens
  Payload ID: 14925
  Gene Symbol: ROGDI
  Gene Name: rogdi homolog
  ENSP ID: ENSP00000467509
MATVMAATAAERAVLEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKVGP

SEQ ID NO: 75596 - protein, 73 aa, Homo sapiens
  Payload ID: 14925
  Gene Symbol: ROGDI
  Gene Name: rogdi homolog
  ENSP ID: ENSP00000468334
  MOD_RES (1)..(1): Any amino acid
XNQLLHFAFREDKQWKLQQIQDARNHVSHVHKVECVIPWLNDALVYFTVSLQLCQQLKDKISVFSSYWSYRPF

SEQ ID NO: 75597 - protein, 230 aa, Homo sapiens
  Payload ID: 14925
  Gene Symbol: ROGDI
  Gene Name: rogdi homolog
  ENSP ID: ENSP00000468343
MATVMAATAAERAVLEEEFRWLLHDEVHAVLKQLQDILKEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEPTPPLPAADGRSDAAADQSPKPAHHPRHPHPPRDRRQRPHADVRPCPAVRPAGQRLHQPQQALPHGVPAACPAAQLHQELPPSWGRGAA

SEQ ID NO: 75598 - protein, 2341 aa, Homo sapiens
  Payload ID: 14926
  Gene Symbol: ROS1
  Gene Name: ROS proto-oncogene 1 , receptor tyrosine kinase
  ENSP ID: ENSP00000357493
MKNIYCLIPKLVNFATLGCLWISVVQCTVLNSCLKSCVTNLGQQLDLGTPHNLSEPCIQGCHFWNSVDQKNCALKCNDTYATVCERESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGASPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 75599 - protein, 2347 aa, Homo sapiens
  Payload ID: 14926
  Gene Symbol: ROS1
  Gene Name: ROS proto-oncogene 1 , receptor tyrosine kinase
  Uniprot ID: P08922
  ENSP ID: ENSP00000357494
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 75600 - protein, 97 aa, Homo sapiens
  Payload ID: 14926
  Gene Symbol: ROS1
  Gene Name: ROS proto-oncogene 1 , receptor tyrosine kinase
  ENSP ID: ENSP00000384647
WKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRD

SEQ ID NO: 75601 - protein, 2226 aa, Homo sapiens
  Payload ID: 14927
  Gene Symbol: RTTN
  Gene Name: rotatin
  Uniprot ID: Q86VV8
  ENSP ID: ENSP00000255674
MVLAGLIRKLGHQLAEIRERALKSILCKIEHNLICYADLIQERQLFLHLLEWFNFPSVPMKEEVLNLLSRLVKYPPAVQHLVDVGAVEFLSKLRSNVEPNLQAEIDGILDGLFLLPSEVPALSSASYQTNQTELSKNPEILTGYFPQDKSNFQQMEVPPRPVVNQTVKCLKFSTFPWLPLTTTDRHVLSSNESSLRSSNHTLIWNTCELLKDVIMQDFPAEIFLQRPKIVQSLLSLLKLAFGDGKHRLALQSVSCLQQLCMYLRNRLNFHRDPGFFSNKHDTVSQNSSLSYCHEARGTHHSQNPSPGSSSPRPSVVGRTGQRPRGDGQDWDAASSSGSSSHAHVNSRISVHSPLDMGHIDLPELETEDTLELQFQQLSLPQFCVSILESAVPLLRTGSRQVIIRVLELLTEDMTLIGEAISTDIWDDSSLFGIDMKEKLLLVLGALGETMCYHKSSISLEQPEVMLVHHRMAFISISLFAVRLLQTLLPVEKASEFLSEPMSTALFLLSLDMPISLEYPNIHEAVVAYLEQLNSENYSIYKRTAEAVYSIECTCNFLSDIGKEGEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQDIKMHAVVKKLCLIDKIIEYLNECVSQDGKVVECLVQPCLTLLRKVLCGDPVMRVSLSQQSSLLTVLFRVSLIFHEDCSVVTEVGALFCLLLFDEVSRMDMWSVNPSNKPSLPSVFSLPVSVFRRYHLPVHVIGHHAVSPYSIVLPLSADCLALKPVSDMLRIAWNLSWYHGSDNLLKQMNSETKTQEILDALKLSTEDILTLKITHMASGLQDCLHSIVQAATHREVRAAVTRMSFYLLNDRLSLKGCPGPCGVTLKSLAWHTALNRFLQVLPACTEDEKLLIDIIHFLNKLIKEQRKNSSLELLNWILELLLRHSANPLLDLLVLTESQAREETDDIRTAVRQQLQKELIALFDTLLLNFMEVTDRKCSELLYVFQTQLALKLLQCLKVTDAPHFYGLPSLERTLRGMANLTAFPGWSSHSPLTKPLDICVKYLSGLLEVITSFYVERGGNAMSFMGKGVTKSTILCLLHLSHEMMAQAGSLEWMSLWFLPLGSHSEEHIPTQQGLAWLIPLWVDRDPEVRFTSLGLGSALTTLETGCVALANSCQNISGGLWGTVVNILLDQSECSMVRREAAFILQNLLVIPMPTEIIKDYTWQGPCVHDEDSGLSLIGKPALQALLYHCHFYEHLNQMVKHCYLGRCMFDLNFSAFDRNSESNDLNGLDDSFKFWRAPSRTSQDRDPSSLSTSETTVAPSLGSTEFQPLVQSTTLLPEASHDQFVAQGHQESTSPRPPHDSSLSAPLPKLCVFVTPSLLSAMCSLLDNLLTIAPRDTAKAFRQAHLIELLCSIADATLIQTCVQELRALLPSSPPAEHTQAQVSFLLEYLSSLSRLLQSCLLVEPDLVIQDELVKPLITNIIGILTICTKDVLDKELISAFYHTWTHLFNLLAMLLRKAGAITLPFVTVALAKHWTAAIDMFCTCAGLSATCPALYTASLQFLSVLLTEEAKGHLQAKSKTHLCCSPTVASLLDDSQENQKSLEQLSDVILQCYEGKSSKDILKRVAANALMSLLAVSRRAQKHALKANLIDNCMEQMKHINAQLNLDSLRPGKAALKKKEDGVIKELSIAMQLLRNCLYQNEECKEAALEAHLVPVLHSLWPWILMDDSLMQISLQLLCVYTANFPNGCSSLCWSSCGQHPVQATHRGAVSNSLMLCILKLASQMPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTFPNSEANPLNAYYLKCLENLVQLLNSS

SEQ ID NO: 75602 - protein, 184 aa, Homo sapiens
  Payload ID: 14927
  Gene Symbol: RTTN
  Gene Name: rotatin
  ENSP ID: ENSP00000462675
  MOD_RES (1)..(1): Any amino acid
XASQMPLENTTVQQMVFMLLSNLALSHDCKGVIQKSNFLQNFLSLALPKGGNKHLSNLTILWLKLLLNISSGEDGQQMILRLDGCLDLLTEMSKYKHKSSPLLPLLIFHNVCFSPANKPKILANEKVITVLAACLESENQNAQRIGAAALWALIYNYQKAKTALKSPSVKRRVDEAYSLAKKTP

SEQ ID NO: 75603 - protein, 669 aa, Homo sapiens
  Payload ID: 14927
  Gene Symbol: RTTN
  Gene Name: rotatin
  ENSP ID: ENSP00000462733
KDVIMQDFPAEIFLQRPKIVQSLLSLLKLAFGDGKHRLALQSVSCLQQLCMYLRNRLNFHRDPGFFSNKHDTVSQNSSLSYCHEARGTHHSQNPSPGSSSPRPSVVGRTGQRPRGDGQDWDAASSSGSSSHAHVNSRISVHSPLDMGHIDLPELETEDTLELQFQQLSLPQFCVSILESAVPLLRTGSRQVIIRVLELLTEDMTLIGEAISTDIWDDSSLFGIDMKEKLLLVLGALGETMCYHKSSISLEQPEVMLVHHRMAFISISLFAVRLLQTLLPVEKASEFLSEPMSTALFLLSLDMPISLEYPNIHEAVVAYLEQLNSENYSIYKRTAEAVYSIECTCNFLSDIGKEGEKNLLELVELADQALRSFSYHQHFPLIKEIISICSKIWKSAQASPLLQGESQKVLLHMLSHPLPRVKAETYHCCLEITKECLGVHNVTKPVSSLCNGIHFLLHPKVLYEISVFGIQEPESEVNTAAKAILLYLLQGRLMMTALTWNKFIESLCPVIPILQGYADTEDPLGNCILLLSKASSDTEEMLPCTTRLKSMLRLLLVKKPSVRSLALKLLAFHLTSEEGADTKRPLIDARVLSRVTDLFIGKKPIELRLDDRRELVIKLETVEKVYEIFTSDDVDLVLRKSAAEQLAVIMQGCRMFGTTMPHTLEEGFMW

SEQ ID NO: 75604 - protein, 500 aa, Homo sapiens
  Payload ID: 14927
  Gene Symbol: RTTN
  Gene Name: rotatin
  ENSP ID: ENSP00000462926
MVLAGLIRKLGHQLAEIRERALKSILCKIEHNLICYADLIQERQLFLHLLEWFNFPSVPMKEEVLNLLSRLVKYPPAVQHLVDVGAVEFLSKLRSNVEPNLQAEIDGILDGLFLLPSEVPALSSASYQTNQTELSKNPEILTGYFPQDKSNFQQMEVPPRPVVNQTVKCLKFSTFPWLPLTTTDRHVLSSNESSLRSSNHTLIWNTCELLKDVIMQDFPAEIFLQRPKIVQSLLSLLKLAFGDGKHRLALQSVSCLQQLCMYLRNRLNFHRDPGFFSNKHDTVSQNSSLSYCHEARGTHHSQNPSPGSSSPRPSVVGRTGQRPRGDGQDWDAASSSGSSSHAHVNSRISVHSPLDMGHIDLPELETEDTLELQFQQLSLPQFCVSILESAVPLLRTGSRQVIIRVLELLTEDMTLIGEAISTDIWDDSSLFGIDMKEKLLLVLGALGETMCYHKSSISLEQPEVMLVHHRMAFISISLFAVRLLQTLLPVEKLLWPIWNS

SEQ ID NO: 75605 - protein, 802 aa, Homo sapiens
  Payload ID: 14928
  Gene Symbol: RSBN1
  Gene Name: round spermatid basic protein 1
  Uniprot ID: Q5VWQ0
  ENSP ID: ENSP00000261441
MFISGRRTADKWRAEERLQCPAGSARAALARCADGGAVGPFKCVFVGEMAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVNRTYCCGTYRAGPMRQISLVGAVDEEVGDYFPEFLDMLEESPFLKMTLPWGTLSSLRLQCRSQSDDGPIMWVRPGEQMIPTADMPKSPFKRRRSMNEIKNLQYLPRTSEPREVLFEDRTRAHADHVGQGFDWQSTAAVGVLKAVQFGEWSDQPRITKDVICFHAEDFTDVVQRLQLDLHEPPVSQCVQWVDEAKLNQMRREGIRYARIQLCDNDIYFIPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKVESRLDSDQQHNLQEHSTTSV

SEQ ID NO: 75606 - protein, 411 aa, Homo sapiens
  Payload ID: 14928
  Gene Symbol: RSBN1
  Gene Name: round spermatid basic protein 1
  ENSP ID: ENSP00000433256
MAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQ

SEQ ID NO: 75607 - protein, 685 aa, Homo sapiens [sequence omitted]

SEQ ID NO: 75608 - protein, 802 aa, Homo sapiens; identical to SEQ ID NO: 75605
  Payload ID: 14928
  Gene Symbol: RSBN1
  Gene Name: round spermatid basic protein 1
  Uniprot ID: Q5VWQ0
  ENSP ID: ENSP00000479490

SEQ ID NO: 75609 - protein, 754 aa, Homo sapiens
  Payload ID: 14928
  Gene Symbol: RSBN1
  Gene Name: round spermatid basic protein 1
  ENSP ID: ENSP00000480408
MAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVNRTYCCGTYRAGPMRQISLVGAVDEEVGDYFPEFLDMLEESPFLKMTLPWGTLSSLRLQCRSQSDDGPIMWVRPGEQMIPTADMPKSPFKRRRSMNEIKNLQYLPRTSEPREVLFEDRTRAHADHVGQGFDWQSTAAVGVLKAVQFGEWSDQPRITKDVICFHAEDFTDVVQRLQLDLHEPPVSQCVQWVDEAKLNQMRREGIRYARIQLCDNDIYFIPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKVESRLDSDQQHNLQEHSTTSV

SEQ ID NO: 75610 - protein, 846 aa, Homo sapiens
  Payload ID: 14929
  Gene Symbol: RSBN1L
  Gene Name: round spermatid basic protein 1-like
  Uniprot ID: Q6PCB5
  ENSP ID: ENSP00000334040
MAEPPSPVHCVAAAAPTATVSEKEPFGKLQLSSRDPPGSLSAKKVRTEEKKAPRRVNGEGGSGGNSRQLQPPAAPSPQSYGSPASWSFAPLSAAPSPSSSRSSFSFSAGTAVPSSASASLSQPVPRKLLVPPTLLHAQPHHLLLPAAAAAASANAKSRRPKEKREKERRRHGLGGAREAGGASREENGEVKPLPRDKIKDKIKERDKEKEREKKKHKVMNEIKKENGEVKILLKSGKEKPKTNIEDLQIKKVKKKKKKKHKENEKRKRPKMYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEILGKKDIETTTMSNFHAQVKRTYSHGTYRAGPMRQISLVGAVDEEVGDYFPEFLDMLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYDNDIYFIPRNVVHQFKTVSAVCSLAWHIRLKLYHSEEDTSQNTATHETGTSSDSTSSVLGPHTDNMICAVSKASLDSVFSDKLHSKYELQQIKHEPIASVRIKEEPVNVNIPEKTTALNNMDGKNVKAKLDHVQFAEFKIDMDSKFENSNKDLKEELCPGNLSLVDTRQHSSAHSNQDKKDDDILC

SEQ ID NO: 75611 - protein, 576 aa, Homo sapiens
  Payload ID: 14929
  Gene Symbol: RSBN1L
  Gene Name: round spermatid basic protein 1-like
  Uniprot ID: Q6PCB5
  ENSP ID: ENSP00000393888
MYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEILGKKDIETTTMSNFHAQVKRTYSHGTYRAGPMRQISLVGAVDEEVGDYFPEFLDMLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYDNDIYFIPRNVVHQFKTVSAVCSLAWHIRLKLYHSEEDTSQNTATHETGTSSDSTSSVLGPHTDNMICAVSKASLDSVFSDKLHSKYELQQIKHEPIASVRIKEEPVNVNIPEKTTALNNMDGKNVKAKLDHVQFAEFKIDMDSKFENSNKDLKEELCPGNLSLVDTRQHSSAHSNQDKKDDDILC

SEQ ID NO: 75612 - protein, 177 aa, Homo sapiens
  Payload ID: 14929
  Gene Symbol: RSBN1L
  Gene Name: round spermatid basic protein 1-like
  ENSP ID: ENSP00000405231
CTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQECCSSVQDSFSCMQFSMAYSAQIISLRGGHFSEYSYS

SEQ ID NO: 75613 - protein, 199 aa, Homo sapiens
  Payload ID: 14929
  Gene Symbol: RSBN1L
  Gene Name: round spermatid basic protein 1-like
  ENSP ID: ENSP00000414313
MRQISLVGAVDEEVGDYFPEFLDMLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYD

SEQ ID NO: 75614 - protein, 843 aa, Homo sapiens
  Payload ID: 14929
  Gene Symbol: RSBN1L
  Gene Name: round spermatid basic protein 1-like
  ENSP ID: ENSP00000484678
MAEPPSPVHCVAAAAPTATVSEKEPFGKLQLSSRDPPGSLSAKKVRTEEKKAPRRVNGEGGSGGNSRQLQPPAAPSPQSYGSPASWSFAPLSAAPSPSSSRSSFSFSAGTAVPSSASASLSQPVPRKLLVPPTLLHAQPHHLLLPAAAAAASANAKSRRPKEKREKERRRHGLGGAREAGGASREENGEVKPLPRDKIKDKIKERDKEKEREKKKHKVMNEIKKENGEVKILLKSGKEKPKTNIEDLQIKKVKKKKKKKHKENEKRKRPKMYSKSIQTICSGLLTDVEDQAAKGILNDNIKDYVGKNLDTKNYDSKIPENSEFPFVSLKEPRVQNNLKRLDTLEFKQLIHIEHQPNGGASVIHAYSNELSHLSPMEMERFAEEFVGLVFSENENSAAFYVMGIVHGAATYLPDFLDYFSFNFPNSPVKMEIERKITTTMSNFHAQVKRTYSHGTYRAGPMRQISLVGAVDEEVGDYFPEFLDMLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYDNDIYFIPRNVVHQFKTVSAVCSLAWHIRLKLYHSEEDTSQNTATHETGTSSDSTSSVLGPHTDNMICAVSKASLDSVFSDKLHSKYELQQIKHEPIASVRIKEEPVNVNIPEKTTALNNMDGKNVKAKLDHVQFAEFKIDMDSKFENSNKDLKEELCPGNLSLVDTRQHSSAHSNQDKKDDDILC

SEQ ID NO: 75615 - protein, 1531 aa, Homo sapiens
  Payload ID: 14930
  Gene Symbol: ROBO1
  Gene Name: roundabout guidance receptor 1
  ENSP ID: ENSP00000406043
MLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEGNAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGNQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 75616 - protein, 1551 aa, Homo sapiens
  Payload ID: 14930
  Gene Symbol: ROBO1
  Gene Name: roundabout guidance receptor 1
  Uniprot ID: Q9Y6N7
  ENSP ID: ENSP00000417992
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQVGSEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVTYQRGGEAVSSGGRPGLLNISEPAAQPWLADTWPNTGNNHNDCSISCCTAGNGNSDSNLTTYSRPGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 75617 - protein, 192 aa, Homo sapiens
  Payload ID: 14930
  Gene Symbol: ROBO1
  Gene Name: roundabout guidance receptor 1
  ENSP ID: ENSP00000418553
VDGTFVLSCVATGSPVPTILWRKDGVLVSTQDSRIKQLENGVLQIRYAKLGDTGRYTCIASTPSGEATWSAYIEVQGKVNEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQ

SEQ ID NO: 75618 - protein, 190 aa, Homo sapiens
  Payload ID: 14930
  Gene Symbol: ROBO1
  Gene Name: roundabout guidance receptor 1
  ENSP ID: ENSP00000418946
  MOD_RES (1)..(1): Any amino acid
XFQNSDLLFILLVSRFGMSDHNKEPGMQLDDRLLLTTFQWQAYHLDFHLCLNYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATL

SEQ ID NO: 75619 - protein, 41 aa, Homo sapiens
  Payload ID: 14930
  Gene Symbol: ROBO1
  Gene Name: roundabout guidance receptor 1
  ENSP ID: ENSP00000419915
MKWKHVPFLVMISLLSLSPNHLFLAQLIPGLKPTKEPRKIL

SEQ ID NO: 75620 - protein, 1651 aa, Homo sapiens
  Payload ID: 14930
  Gene Symbol: ROBO1
  Gene Name: roundabout guidance receptor 1
  Uniprot ID: Q9Y6N7
  ENSP ID: ENSP00000420321
MKWKHVPFLVMISLLSLSPNHLFLAQLIPDPEDVERGNDHGTPIPTSDNDDNSLGYTGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 75621 - protein, 1606 aa, Homo sapiens
  Payload ID: 14930
  Gene Symbol: ROBO1
  Gene Name: roundabout guidance receptor 1
  Uniprot ID: Q9Y6N7
  ENSP ID: ENSP00000420637
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQVGSEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 75622 - protein, 1606 aa, Homo sapiens [sequence omitted]

SEQ ID NO: 75623 - protein, 1525 aa, Homo sapiens
  Payload ID: 14930
  Gene Symbol: ROBO1
  Gene Name: roundabout guidance receptor 1
  ENSP ID: ENSP00000482448
MLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQVGSEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEGNAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGNQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 75624 - protein, 1439 aa, Homo sapiens
  Payload ID: 14931
  Gene Symbol: ROBO2
  Gene Name: roundabout guidance receptor 2
  ENSP ID: ENSP00000327536
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGSMVNGWGSASDEDRNFSSHRSSVGSSSDGSIFASGSFAQALVAAADKAGFRLDGTSLTRTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 75625 - protein, 1378 aa, Homo sapiens
  Payload ID: 14931
  Gene Symbol: ROBO2
  Gene Name: roundabout guidance receptor 2
  Uniprot ID: Q9HCK4
  ENSP ID: ENSP00000417164
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 75626 - protein, 1394 aa, Homo sapiens
  Payload ID: 14931
  Gene Symbol: ROBO2
  Gene Name: roundabout guidance receptor 2
  Uniprot ID: Q9HCK4
  ENSP ID: ENSP00000417335
MARRHERVTRRMWTWAPGLLMMTVVFWGHQGNGQGQGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 75627 - protein, 198 aa, Homo sapiens
  Payload ID: 14931
  Gene Symbol: ROBO2
  Gene Name: roundabout guidance receptor 2
  ENSP ID: ENSP00000417471
  MOD_RES (1)..(1): Any amino acid
XSNTSAALSQSQRPRPTKKHKGGRMDQQPALPHRREGMTDDLPPPPDPPPGQGLRQQIGPSQQAGNVENSAERKGSSLERQHASSLEDTKSSLDCPARTSLEWQRQTQEWISSTERQEDIRKAPHKQGVGSEEALVPYSKPSFPSPGGHSSSGTASSKGSTGPRKTEVLRAGHQRNASDLLDIGYMGSNSQGQFTGEL

SEQ ID NO: 75628 - protein, 564 aa, Homo sapiens
  Payload ID: 14931
  Gene Symbol: ROBO2
  Gene Name: roundabout guidance receptor 2
  ENSP ID: ENSP00000418117
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFRYVV

SEQ ID NO: 75629 - protein, 214 aa, Homo sapiens
  Payload ID: 14931
  Gene Symbol: ROBO2
  Gene Name: roundabout guidance receptor 2
  ENSP ID: ENSP00000418190
  MOD_RES (1)..(1): Any amino acid
XSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNALLYIPDYRLAEGLSNRMPHNQSQDFSTTSSHNSSERSGSLSGGKGGKKKKNKNSSKPQKNNGSTWANVPLPPPPVQPLPGTELEHYAVEQQEN

SEQ ID NO: 75630 - protein, 342 aa, Homo sapiens
  Payload ID: 14931
  Gene Symbol: ROBO2
  Gene Name: roundabout guidance receptor 2
  ENSP ID: ENSP00000418344
  MOD_RES (1)..(1): Any amino acid
XNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTW

SEQ ID NO: 75631 - protein, 208 aa, Homo sapiens
  Payload ID: 14931
  Gene Symbol: ROBO2
  Gene Name: roundabout guidance receptor 2
  ENSP ID: ENSP00000418446
  MOD_RES (1)..(1): Any amino acid
XDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTE

SEQ ID NO: 75632 - protein, 1070 aa, Homo sapiens
  Payload ID: 14931
  Gene Symbol: ROBO2
  Gene Name: roundabout guidance receptor 2
  ENSP ID: ENSP00000473268
MARRHERVTRRMWTWAPGLLMMTVVFWGHQGNGQGQGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRARPVAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGG

SEQ ID NO: 75633 - protein, 1250 aa, Homo sapiens [sequence omitted]

SEQ ID NO: 75634 - protein, 1386 aa, Homo sapiens
  Payload ID: 14932
  Gene Symbol: ROBO3
  Gene Name: roundabout guidance receptor 3
  Uniprot ID: Q96MS0
  ENSP ID: ENSP00000380903
MLRYLLKTLLQMNLFADSLAGDISNSSELLLGFNSSLAALNHTLLPPGDPSLNGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 75635 - protein, 149 aa, Homo sapiens
  Payload ID: 14932
  Gene Symbol: ROBO3
  Gene Name: roundabout guidance receptor 3
  ENSP ID: ENSP00000438799
MTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 75636 - protein, 1364 aa, Homo sapiens
  Payload ID: 14932
  Gene Symbol: ROBO3
  Gene Name: roundabout guidance receptor 3
  ENSP ID: ENSP00000441797
MERPEDSLSLWSLNLSPQFPCLNALRHPLSPGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 75637 - protein, 1007 aa, Homo sapiens
  Payload ID: 14933
  Gene Symbol: ROBO4
  Gene Name: roundabout guidance receptor 4
  Uniprot ID: Q8WZ75
  ENSP ID: ENSP00000304945
MGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 75638 - protein, 862 aa, Homo sapiens
  Payload ID: 14933
  Gene Symbol: ROBO4
  Gene Name: roundabout guidance receptor 4
  ENSP ID: ENSP00000437129
MVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 75639 - protein, 118 aa, Homo sapiens
  Payload ID: 14934
  Gene Symbol:
  Gene Name: RP11-1012A1.4
  ENSP ID: ENSP00000450554
  MOD_RES (1)..(1): Any amino acid
XRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFRGD

SEQ ID NO: 75640 - protein, 91 aa, Homo sapiens
  Payload ID: 14934
  Gene Symbol:
  Gene Name: RP11-1012A1.4
  ENSP ID: ENSP00000450614
  MOD_RES (1)..(1): Any amino acid
XRIVNVSSLAHHLGRIHFHNLQGEKFYNAGLAYCHSKLANILFTQELARRLKEEKKKLIRDFDEKQQEANETLAEMEEELRYAPLSFRNPM

SEQ ID NO: 75641 - protein, 107 aa, Homo sapiens
  Payload ID: 14935
  Gene Symbol:
  Gene Name: RP11-101E3.5
  ENSP ID: ENSP00000417556
MEASGTTWSPENWSSRELWTILLGRSALRELSQIEAELNKHWRRLLEGLSYYKPPSPSSAEKVKANKDVASPLKELGLRISKFLGLDEEQSVQLLQCYLQEDYRGTR

SEQ ID NO: 75642 - protein, 118 aa, Homo sapiens
  Payload ID: 14936
  Gene Symbol:
  Gene Name: RP11-1021N1.1
  ENSP ID: ENSP00000454340
MAGWWPALSRAARRHPWPTNVLLYGSLVSAGDALQQRLQGREANWRQTRRVATLVVTFHANFNYVWLRLLERALPGRAPHALLAKLLCDQVVGAPIAVSAFYVDQLDIISMAETTMMP

SEQ ID NO: 75643 - protein, 97 aa, Homo sapiens
  Payload ID: 14936
  Gene Symbol:
  Gene Name: RP11-1021N1.1
  ENSP ID: ENSP00000455081
  MOD_RES (1)..(1): Any amino acid
XTNVLLYGSLVSAGDALQQRLQGREANWRQTRRVATLVVTFHANFNYVWLRLLERALPGRAPHALLAKLLCDQVVGAPIAVSAFYVGSHSIPQAEVQ

SEQ ID NO: 75644 - protein, 120 aa, Homo sapiens
  Payload ID: 14936
  Gene Symbol:
  Gene Name: RP11-1021N1.1
  ENSP ID: ENSP00000457071
  MOD_RES (1)..(1): Any amino acid
XTNVLLYGSLVSAGDALQQRLQGREANWRQTRRVATLVVTFHANFNYVWLRLLERALPGRAPHALLAKLLCDQVVGAPIAVSAFYVELSPAPLSPYPAPKPPLQASTAHVPCIPAPSGYP

SEQ ID NO: 75645 - protein, 120 aa, Homo sapiens; identical to SEQ ID NO: 75644
  Payload ID: 14936
  Gene Symbol:
  Gene Name: RP11-1021N1.1
  ENSP ID: ENSP00000487660
  MOD_RES (1)..(1): Any amino acid

SEQ ID NO: 75646 - protein, 97 aa, Homo sapiens; identical to SEQ ID NO: 75643
  Payload ID: 14936
  Gene Symbol:
  Gene Name: RP11-1021N1.1
  ENSP ID: ENSP00000487779
  MOD_RES (1)..(1): Any amino acid

SEQ ID NO: 75647 - protein, 118 aa, Homo sapiens; identical to SEQ ID NO: 75642
  Payload ID: 14936
  Gene Symbol:
  Gene Name: RP11-1021N1.1
  ENSP ID: ENSP00000488150

SEQ ID NO: 75648 - protein, 237 aa, Homo sapiens
  Payload ID: 14937
  Gene Symbol:
  Gene Name: RP11-1035H13.3
  ENSP ID: ENSP00000454746
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIATMVRMNVLADALKSINNAEKRGKRQVLIRPCSKVIVRFLTVMMKHGYIGEFEIIDDHRAGKIVVNLTGRLNK

SEQ ID NO: 75649 - protein, 227 aa, Homo sapiens
  Payload ID: 14938
  Gene Symbol:
  Gene Name: RP11-106M3.2
  ENSP ID: ENSP00000478716
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGTPEQKALVIGGEACMWGEYVDNTNLVPRLWPRAGAVAERLWSNKLTSDLTFAYERLSHFRCELLRLQGRRMCLRLRGKKVVKDTEDRDV

SEQ ID NO: 75650 - protein, 481 aa, Homo sapiens; identical to SEQ ID NO: 20762
  Payload ID: 14939
  Gene Symbol:
  Gene Name: RP11-106M3.5
  ENSP ID: ENSP00000454749

SEQ ID NO: 75651 - protein, 1700 aa, Homo sapiens
  Payload ID: 14940
  Gene Symbol:
  Gene Name: RP11-1070B7.1
  ENSP ID: ENSP00000480274
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTIHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDPSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 75652 - protein, 738 aa, Homo sapiens
  Payload ID: 14940
  Gene Symbol:
  Gene Name: RP11-1070B7.1
  ENSP ID: ENSP00000485882
MQFLHKLILNHNPLTTVEDPYLFKLPALKYLDMGTTLVPLTTLKNILMMTVELEKLILPSHMACCLCQFKNSIEAVCKTVKLHCNSACLTNTIHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDPSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPRRGCSSRRESQDGLSSFGQPLWFKDMYKPLSATRINNHAWKLHKKSSNEDKILNRDPGDSEAPTEEEESEALP

SEQ ID NO: 75653 - protein, 1635 aa, Homo sapiens
  Payload ID: 14940
  Gene Symbol:
  Gene Name: RP11-1070B7.1
  ENSP ID: ENSP00000487050
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTIHCPEEASVGNPEGAFMKVLQARKNYTSTELIVEPEEPSDSSGINLSGFGSEQLDTNDESDFISTLRYILPYFSAVNLDVKSLLLPLIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDPSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRDSEAPTEEEESEALP

SEQ ID NO: 75654 - protein, 339 aa, Homo sapiens
  Payload ID: 14941
  Gene Symbol:
  Gene Name: RP11-108K14.8
  ENSP ID: ENSP00000436767
MDTSPDPVCGGSHTSHVLLHDARGSAVGMEGGRPPPQSVGPAGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNIIQPNYPAAARDFLQTFRRGLLGSVMLDLDVLRGHPPAETLP

SEQ ID NO: 75655 - protein, 213 aa, Homo sapiens
  Payload ID: 14942
  Gene Symbol:
  Gene Name: RP11-108O10.8
  ENSP ID: ENSP00000441304
  MOD_RES (1)..(1): Any amino acid
XKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGLPWLVEGLGSA

SEQ ID NO: 75656 - protein, 144 aa, Homo sapiens
  Payload ID: 14942
  Gene Symbol:
  Gene Name: RP11-108O10.8
  ENSP ID: ENSP00000479200
  MOD_RES (1)..(1): Any amino acid
XSQPRIFRIKLGNQWFSFPEPEALVGKLNRLSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFY

SEQ ID NO: 75657 - protein, 844 aa, Homo sapiens
  Payload ID: 14942
  Gene Symbol:
  Gene Name: RP11-108O10.8
  ENSP ID: ENSP00000482396
MAPRRLLLVGEGNFSFAAALSETLDQSTQLTATCLQRPAELARDPLAWENLQCLRERGIDVRFGVDCTQLADVFELHEREFDQIYFIFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRLAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 75658 - protein, 5 aa, Homo sapiens
  Payload ID: 14943
  Gene Symbol:
  Gene Name: RP11-1099M24.7
  ENSP ID: ENSP00000461816
  MOD_RES (1)..(1): Any amino acid
XARAG

SEQ ID NO: 75659 - protein, 191 aa, Homo sapiens
  Payload ID: 14944
  Gene Symbol:
  Gene Name: RP11-111H13.1
  ENSP ID: ENSP00000390891
MSSTLGKLSNQVEETLPLLKKPLKRAITTLMAGILRLVVQWPPGRLQTVTKGVESLICTDWIRHKFTRSRIPEKVFQASPEDHEKYGGDPQNPHKLHIVTRIKSTRRRPYWEKDIIKMLGLEKAHTPQVHKNIPSVNAKLKVVKHLIRIKPLKLPQGLPAEENMSNTCLKSTGELVVQWHLKPVEQKAHES

SEQ ID NO: 75660 - protein, 234 aa, Homo sapiens; identical to SEQ ID NO: 67852
  Payload ID: 14945
  Gene Symbol:
  Gene Name: RP11-111K18.1
  ENSP ID: ENSP00000455744

SEQ ID NO: 75661 - protein, 48 aa, Homo sapiens
  Payload ID: 14945
  Gene Symbol:
  Gene Name: RP11-111K18.1
  ENSP ID: ENSP00000456999
MAERGYSFSLTTFSPSGKLVQIEYALAAVAGGAPSVGIKECLCTELEN

SEQ ID NO: 75662 - protein, 254 aa, Homo sapiens
  Payload ID: 14946
  Gene Symbol:
  Gene Name: RP11-111M22.2
  Uniprot ID: Q3ZCU0
  ENSP ID: ENSP00000323821
MSDRYLEQRISIKFCVKLNKSASETHHLLKEAYGDEVMSRARVFDWHKRFKEGREDVRDDARSGRPVTHRTDDNIQKVKDLVCSNRQLTVRMMAEELNLDKETVRLILKENLNMRKISAKVISGVLKETEPHYVAQAGLELLVSRDPPTLASQSSGIISMSHHAKPKPGVQWCKFQSESTGRRARSADVQGQEKMDVTAQEARTNLPFYLFVLFRSSMNWMMSMHIREGCLFITRSTNSNANLFRKHPHRHTQK

SEQ ID NO: 75663 - protein, 187 aa, Homo sapiens
  Payload ID: 14946
  Gene Symbol:
  Gene Name: RP11-111M22.2
  ENSP ID: ENSP00000489195
MSDRYLEQRISIKFCVKLNKSASETHHLLKEAYGDEVMSRARVFDWHKRFKEGREDVRDDARSGRPVTHRTDDNIQKVKDLVCSNRQLTVRMMAEELNLDKETVRLILKENLNMRKISAKVISGVLKGEPKPRKLDFRSDLSKETRKNSSCLRKKRRNLTMLPRLVSNSLSQGILPPWPPKALGLSA

SEQ ID NO: 75664 - protein, 210 aa, Homo sapiens
  Payload ID: 14946
  Gene Symbol:
  Gene Name: RP11-111M22.2
  ENSP ID: ENSP00000489606
MSDRYLEQRISIKFCVKLNKSASETHHLLKEAYGDEVMSRARVFDWHKRFKEGREDVRDDARSGRPVTHRTDDNIQKVKDLVCSNRQLTVRMMAEELNLDKETVRLILKENLNMRKISAKVISGVLKGEPKPRKLDFRSDLSKETRKNSSCLRKKVTGSETWSYLQGEAGGEMPLPVSHPRVHYSASQLLQASSSTSLPPRVAENWFTPW

SEQ ID NO: 75665 - protein, 43 aa, Homo sapiens
  Payload ID: 14947
  Gene Symbol:
  Gene Name: RP11-11N7.5
  ENSP ID: ENSP00000479468
  MOD_RES (1)..(1): Any amino acid
XILGSEAMESALSPRILLNTQIKRTDTYFSKTFTRSRLFSLVG

SEQ ID NO: 75666 - protein, 64 aa, Homo sapiens
  Payload ID: 14947
  Gene Symbol:
  Gene Name: RP11-11N7.5
  ENSP ID: ENSP00000482621
  MOD_RES (1)..(1): Any amino acid
XGRGSYSNRGNYNRGGMPNRGNYNQNFRGRGNNRGYKNQSQGYNQWQQGSVHVNVLCGRVKGPN

SEQ ID NO: 75667 - protein, 153 aa, Homo sapiens; identical to SEQ ID NO: 1173
  Payload ID: 14948
  Gene Symbol:
  Gene Name: RP11-1212A22.4
  ENSP ID: ENSP00000331567

SEQ ID NO: 75668 - protein, 369 aa, Homo sapiens; identical to SEQ ID NO: 1174
  Payload ID: 14948
  Gene Symbol:
  Gene Name: RP11-1212A22.4
  ENSP ID: ENSP00000389275

SEQ ID NO: 75669 - protein, 232 aa, Homo sapiens; identical to SEQ ID NO: 1177
  Payload ID: 14948
  Gene Symbol:
  Gene Name: RP11-1212A22.4
  ENSP ID: ENSP00000431760

SEQ ID NO: 75670 - protein, 224 aa, Homo sapiens
  Payload ID: 14948
  Gene Symbol:
  Gene Name: RP11-1212A22.4
  ENSP ID: ENSP00000437314
  MOD_RES (1)..(1): Any amino acid
XRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAER

SEQ ID NO: 75671 - protein, 232 aa, Homo sapiens; identical to SEQ ID NO: 1177
  Payload ID: 14948
  Gene Symbol:
  Gene Name: RP11-1212A22.4
  ENSP ID: ENSP00000440825

SEQ ID NO: 75672 - protein, 79 aa, Homo sapiens; identical to SEQ ID NO: 23494
  Payload ID: 14949
  Gene Symbol:
  Gene Name: RP11-1236K1.1
  ENSP ID: ENSP00000392568

SEQ ID NO: 75673 - protein, 64 aa, Homo sapiens
  Payload ID: 14950
  Gene Symbol:
  Gene Name: RP11-123K3.4
  ENSP ID: ENSP00000477227
YFGMDHNVDQTGKAVIINKTSNTRIPEQRFSEHIKDEKNTEFQQRFILKRDDASMDRDDNQGEP

SEQ ID NO: 75674 - protein, 94 aa, Homo sapiens
  Payload ID: 14951
  Gene Symbol:
  Gene Name: RP11-125O5.2
  ENSP ID: ENSP00000454306
  MOD_RES (1)..(1): Any amino acid
XYGWSASKTNFLLVLDAFLCAVGLTSYSVLVIRIVQPELKALAIGFHSMIMRSLGGILVPIYFGALIDTTCMKWSTNSCGARGACRIYNSTYLG

SEQ ID NO: 75675 - protein, 63 aa, Homo sapiens
  Payload ID: 14951
  Gene Symbol:
  Gene Name: RP11-125O5.2
  ENSP ID: ENSP00000465144
  MOD_RES (1)..(1): Any amino acid
XIVQPELKALAIGFHSMIMRSLGGILVPIYFGALIDTTCMKWSTNSCGARGACRIYNSTYLGY

SEQ ID NO: 75676 - protein, 78 aa, Homo sapiens
  Payload ID: 14951
  Gene Symbol:
  Gene Name: RP11-125O5.2
  ENSP ID: ENSP00000466239
  MOD_RES (1)..(1): Any amino acid
XCAVGLTSYSVLVIRIVQPELKALAIGFHSMIMRSLGGILVPIYFGALIDTTCMKWSTNSCGARGACRIYNSTYLGIF

SEQ ID NO: 75677 - protein, 96 aa, Homo sapiens
  Payload ID: 14951
  Gene Symbol:
  Gene Name: RP11-125O5.2
  ENSP ID: ENSP00000467209
AFLCAVGLTSYSVLVIRIVQPELKALAIGFHSMIMRSLGGILVPIYFGALIDTTCMKWSTNSCGARGACRIYNSTYLGRAFFGLKYLLGMRHYSWN

SEQ ID NO: 75678 - protein, 89 aa, Homo sapiens
  Payload ID: 14951
  Gene Symbol:
  Gene Name: RP11-125O5.2
  ENSP ID: ENSP00000467594
FLCAVGLTSYSVLVIRIVQPELKALAIGFHSMIMRSLGGILVPIYFGALIDTTCMKWSTNSCGARGACRIYNSTYLGYETLFLELSIQQ

SEQ ID NO: 75679 - protein, 201 aa, Homo sapiens
  Payload ID: 14952
  Gene Symbol:
  Gene Name: RP11-12J10.3
  ENSP ID: ENSP00000455755
  MOD_RES (1)..(1): Any amino acid
XHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFFLITSCNWTKEELLNEFSEGFELLEELPTPKFSFGGRSGNSVAALVFQKM

SEQ ID NO: 75680 - protein, 106 aa, Homo sapiens
  Payload ID: 14953
  Gene Symbol:
  Gene Name: RP11-136C24.3
  ENSP ID: ENSP00000414848
MMTAVSLTTRPQESVAFEDVAVYFTTKEWAIMVPAERALYRDVMLENYEAVAFVVPPTSKPALVSHLEQGKESCFTQPQGVLSRNDWRAGWIGPRPLGSLLLWLRA

SEQ ID NO: 75681 - protein, 101 aa, Homo sapiens
  Payload ID: 14953
  Gene Symbol:
  Gene Name: RP11-136C24.3
  ENSP ID: ENSP00000477043
MMTAVSLTTRPQESVAFEDVAVYFTTKEWAIMVPAERALYRDVMLENYEAVAFVVPPTSKPALVSHLEQGKESCFTQPQGVLSRNDWRAGWIGVLAPEKAA

SEQ ID NO: 75682 - protein, 164 aa, Homo sapiens
  Payload ID: 14954
  Gene Symbol:
  Gene Name: RP11-140L24.4
  ENSP ID: ENSP00000457299
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSSILFMIWALTFSKPVHLLTILTAEPCPLEPVPNQLVLTWRDICLNLWSVI

SEQ ID NO: 75683 - protein, 272 aa, Homo sapiens; identical to SEQ ID NO: 13960
  Payload ID: 14955
  Gene Symbol:
  Gene Name: RP11-141O19.1
  ENSP ID: ENSP00000489328

SEQ ID NO: 75684 - protein, 143 aa, Homo sapiens
  Payload ID: 14956
  Gene Symbol:
  Gene Name: RP11-145E5.5
  ENSP ID: ENSP00000385916
MASGTTTTAVKIGIIGGTGLDDPEILEGRTEKYVDTPFGKPSDALILGKIKNVDCVLLARHGRQHTIMPSKVNYQANIWALKEEGCTHVIVTTACGSLREEIQPGDIVIIDQFIDRTICHDISKDSKREYWCPCCDDSSAPLI

SEQ ID NO: 75685 - protein, 813 aa, Homo sapiens; identical to SEQ ID NO: 47735
  Payload ID: 14957
  Gene Symbol:
  Gene Name: RP11-146B14.1
  ENSP ID: ENSP00000440656

SEQ ID NO: 75686 - protein, 85 aa, Homo sapiens
  Payload ID: 14958
  Gene Symbol:
  Gene Name: RP11-14J7.7
  ENSP ID: ENSP00000338288
KKEHVFIHERPRKINGICISPKKVACQNLSAIFCFQSETKFKMTVCQLIEGTRYPACRYHYSPTEGFVLVTCDDLRPDSFLGYVK

SEQ ID NO: 75687 - protein, 96 aa, Homo sapiens
  Payload ID: 14958
  Gene Symbol:
  Gene Name: RP11-14J7.7
  ENSP ID: ENSP00000477006
MIIMVIIFLVLLFWENEVNDEAVMSTLEHLHVDYPQNDVPVPARRDYTTSEMETFPLLLLSLGLVLAEASESTMKIIKEEFTDEEMQYDMAKSGQE

SEQ ID NO: 75688 - protein, 293 aa, Homo sapiens
  Payload ID: 14959
  Gene Symbol:
  Gene Name: RP11-152F13.10
  ENSP ID: ENSP00000454786
  MOD_RES (1)..(1): Any amino acid
XEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQGRVRTKTVKKAARVIIEKYYTRLGNDFHTNKRV

SEQ ID NO: 75689 - protein, 293 aa, Homo sapiens; identical to SEQ ID NO: 75688
  Payload ID: 14959
  Gene Symbol:
  Gene Name: RP11-152F13.10
  ENSP ID: ENSP00000488785
  MOD_RES (1)..(1): Any amino acid

SEQ ID NO: 75690 - protein, 232 aa, Homo sapiens
  Payload ID: 14960
  Gene Symbol:
  Gene Name: RP11-156P1.2
  ENSP ID: ENSP00000461460
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIETRSHHVAQNGPELLSSRDPPASASRSAGIIEFSEKIT

SEQ ID NO: 75691 - protein, 62 aa, Homo sapiens
  Payload ID: 14961
  Gene Symbol:
  Gene Name: RP11-159D12.5
  ENSP ID: ENSP00000463235
MEAMADRFPDVLPASATDPNCRTSHSSPRPPGSIQWGISSKRNQTNVFQPLHSVASLCVRKG

SEQ ID NO: 75692 - protein, 225 aa, Homo sapiens
  Payload ID: 14962
  Gene Symbol:
  Gene Name: RP11-15K19.2
  ENSP ID: ENSP00000390331
MEEEEMNDGSQMVRSQESLTFQDVAVDFTREEWDQLYPAQKNLYRDVMLENYRNLVALGYQLCKPEVIAQLELEEEWVIERDSLLDTHPGDQSHVMSVVRSSVHARWIVGKVIGTKMQKTAKVRVTRLVLDPYLLKYFNKRKTYFAHDALQQCTVGDIVLLRALPVPRAKHVKHELAEIVFKVGKVIDPVTGKPCAGTTYLESPLSSETTQLSKNLEELNISSAQ

SEQ ID NO: 75693 - protein, 259 aa, Homo sapiens
  Payload ID: 14963
  Gene Symbol:
  Gene Name: RP11-162P23.2
  ENSP ID: ENSP00000450353
MDLAGNKAAALDIAMIKMVAPSMASRVIDRAIQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGST

SEQ ID NO: 75694 - protein, 68 aa, Homo sapiens
  Payload ID: 14964
  Gene Symbol:
  Gene Name: RP11-166N6.3
  ENSP ID: ENSP00000455583
  MOD_RES (1)..(1): Any amino acid
XAIPVSIHVNVILFSAILIVLTMVGTAFFMYNAFGKPFETLHGPLGLYLLSFISEAAADPVWKHSPCL

SEQ ID NO: 75695 - protein, 49 aa, Homo sapiens
  Payload ID: 14964
  Gene Symbol:
  Gene Name: RP11-166N6.3
  ENSP ID: ENSP00000457487
  MOD_RES (1)..(1): Any amino acid
XLTMVGTAFFMYNAFGKPFETLHGPLGLYLLSFISEAAADPVWKHSPCL

SEQ ID NO: 75696 - protein, 72 aa, Homo sapiens
  Payload ID: 14964
  Gene Symbol:
  Gene Name: RP11-166N6.3
  ENSP ID: ENSP00000457784
  MOD_RES (1)..(1): Any amino acid
XAIPVSIHVNVILFSAILIVLTMVGTAFFMYNAFGKPFETLHGPLGLYLLSFISGRAGTTSGSPWNLQVPGV

SEQ ID NO: 75697 - protein, 67 aa, Homo sapiens
  Payload ID: 14965
  Gene Symbol:
  Gene Name: RP11-176H8.1
  ENSP ID: ENSP00000446654
MAEGSRIPQARALLQQCLHARLQIRPADGDVAAQWVEVQRGLVIYVCFFKGADKELLPKMDLRLWLH

SEQ ID NO: 75698 - protein, 67 aa, Homo sapiens; identical to SEQ ID NO: 75697
  Payload ID: 14965
  Gene Symbol:
  Gene Name: RP11-176H8.1
  ENSP ID: ENSP00000447056

SEQ ID NO: 75699 - protein, 63 aa, Homo sapiens
  Payload ID: 14965
  Gene Symbol:
  Gene Name: RP11-176H8.1
  ENSP ID: ENSP00000449799
  MOD_RES (1)..(1): Any amino acid
XIPQARALLQQCLHARLQIRPADGDVAAQWVEVTSARQLSLSSGVRGGFFRVVSVTRPLCVSL

SEQ ID NO: 75700 - protein, 54 aa, Homo sapiens
  Payload ID: 14966
  Gene Symbol:
  Gene Name: RP11-178C3.1
  ENSP ID: ENSP00000468280
STLSESANQVFLGFTYVAPSVLESVKEKFSFEPKIRSPRRFIGSPRTPVRFLVQ

SEQ ID NO: 75701 - protein, 237 aa, Homo sapiens
  Payload ID: 14967
  Gene Symbol:
  Gene Name: RP11-178L8.4
  ENSP ID: ENSP00000454386
  MOD_RES (1)..(1): Any amino acid
XPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMWNSTFQTYKKEVCLPRHSMHPGPWAICCECQTRFGGRLPVSRVEAALPYWVPLSLRPRKQHPCWMHAAGTTAGGSAVMSACCPSSSSSRPPTRTSYRLLQRVCCPSAS

SEQ ID NO: 75702 - protein, 44 aa, Homo sapiens
  Payload ID: 14968
  Gene Symbol:
  Gene Name: RP11-190A12.7
  ENSP ID: ENSP00000454324
LKEEAQKRRERIDEIKRKKLEELSTAVCCADQRGWTGGPVPGRR

SEQ ID NO: 75703 - protein, 57 aa, Homo sapiens
  Payload ID: 14968
  Gene Symbol:
  Gene Name: RP11-190A12.7
  ENSP ID: ENSP00000455924
VQNRIATFEEGRRLKEEAQKRRERIDEIKRKKLEELSTAVCCADQRGWTGGPVPGRR

SEQ ID NO: 75704 - protein, 61 aa, Homo sapiens
  Payload ID: 14968
  Gene Symbol:
  Gene Name: RP11-190A12.7
  ENSP ID: ENSP00000456698
LKEEAQKRRERIDEIKRKKLEELSSLVTRTRGSTMAAFPICSRGSALQPQTQASTMPPSTS

SEQ ID NO: 75705 - protein, 336 aa, Homo sapiens
  Payload ID: 14969
  Gene Symbol:
  Gene Name: RP11-192H23.4
  ENSP ID: ENSP00000431165
MGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQVCTESWKGLWEELGHRWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVAD

SEQ ID NO: 75706 - protein, 171 aa, Homo sapiens
  Payload ID: 14969
  Gene Symbol:
  Gene Name: RP11-192H23.4
  ENSP ID: ENSP00000436369
MGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQVISMTWASCIEM

SEQ ID NO: 75707 - protein, 122 aa, Homo sapiens
  Payload ID: 14969
  Gene Symbol:
  Gene Name: RP11-192H23.4
  ENSP ID: ENSP00000462934
MGAVSCRQGQHTQQGEHTRVAVPHKGGNIRGPWARGWKSLWTGLGTIRSDLEELWELRGHHYLHQESLKPAPVLVEKPLPEWPVPQFINLFLPEFPIRPIRGQQQLKLDCAAAISAHCNLPA

SEQ ID NO: 75708 - protein, 171 aa, Homo sapiens; identical to SEQ ID NO: 75706
  Payload ID: 14969
  Gene Symbol:
  Gene Name: RP11-192H23.4
  ENSP ID: ENSP00000464466

SEQ ID NO: 75709 - protein, 280 aa, Homo sapiens
  Payload ID: 14970
  Gene Symbol:
  Gene Name: RP11-195F19.29
  ENSP ID: ENSP00000451792
MSRSGTDPQQRQQASEADAAAATFRANDHQHIRYNPLQDEWVLVSAHRMKRPWQGQVEPQLLKTVPRHDPLNPLCPGAIRANGEIFENKGAMMGCSNPHPHCQVWASSFLPDIAQREERSQQAYKSQHGEPLLMEYSRQELLRKMSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQ

SEQ ID NO: 75710 - protein, 87 aa, Homo sapiens
  Payload ID: 14971
  Gene Symbol:
  Gene Name: RP11-195F19.5
  ENSP ID: ENSP00000452132
MSGMRRYEVALEAEEEIYWGCFYFFPWLRMWRRERSSAHPGEQKLEPLRGLMSCLSSGLGPTPQRSGRGFPRRSPTAAAQPASALKI

SEQ ID NO: 75711 - protein, 36 aa, Homo sapiens
  Payload ID: 14971
  Gene Symbol:
  Gene Name: RP11-195F19.5
  ENSP ID: ENSP00000454254
MSGMRRYEVALEAEEEIYWGCFYFFPWLRMWRRERR

SEQ ID NO: 75712 - protein, 36 aa, Homo sapiens; identical to SEQ ID NO: 75711
  Payload ID: 14971
  Gene Symbol:
  Gene Name: RP11-195F19.5
  ENSP ID: ENSP00000455581

SEQ ID NO: 75713 - protein, 87 aa, Homo sapiens; identical to SEQ ID NO: 75710
  Payload ID: 14971
  Gene Symbol:
  Gene Name: RP11-195F19.5
  ENSP ID: ENSP00000457701

SEQ ID NO: 75714 - protein, 166 aa, Homo sapiens
  Payload ID: 14972
  Gene Symbol:
  Gene Name: RP11-196G11.1
  ENSP ID: ENSP00000431371
MGSTWGSPGWVRLALCLTGLVLSLYALHVKAARARDRDYRALCDVGTAISCSRVFSSRWGRGFGLVEHVLGQDSILNQSNSIFGCIFYTLQLLLGLQAAQRACGQRGPGPPKPQEGNTVPGEWPWQASVRRQGAHICSGSLVADTWVLTAAHCFEKAAATELNSWS

SEQ ID NO: 75715 - protein, 121 aa, Homo sapiens
  Payload ID: 14972
  Gene Symbol:
  Gene Name: RP11-196G11.1
  ENSP ID: ENSP00000433035
  MOD_RES (1)..(1): Any amino acid
XDVGTAISCSRVFSSRWGRGFGLVEHVLGQDSILNQSNSIFGCIFYTLQLLLGCLRTRWASVLMLLSSLVSLAGSVYLAWILFFVLYDFCIVCITTYAINVSLMWLSFRKVQEPQGKAKRH

SEQ ID NO: 75716 - protein, 104 aa, Homo sapiens
  Payload ID: 14972
  Gene Symbol:
  Gene Name: RP11-196G11.1
  ENSP ID: ENSP00000460316
MGSTWGSPGWVRLALCLTGLVLSLYALHVKAARARDRDYRALCDVGTAISCSRVFSSRAAATELNSWSVVLGSLQREGLSPGAEEVGVAALQLPRAYNHYSQGS

SEQ ID NO: 75717 - protein, 28 aa, Homo sapiens
  Payload ID: 14973
  Gene Symbol:
  Gene Name: RP11-201K10.3
  ENSP ID: ENSP00000477381
  MOD_RES (1)..(1): Any amino acid
XGAMCPLAVPIVAPMRRVAADAPGTRKA

SEQ ID NO: 75718 - protein, 376 aa, Homo sapiens
  Payload ID: 14974
  Gene Symbol:
  Gene Name: RP11-20I23.1
  ENSP ID: ENSP00000455547
MDSPGYNCFVDKDKMDAAIQDLGPKELSCTELQELKQLARQGYWAQSHALRGKVYQRLIRDIPCRTVTPDASVYSDIVGKIVGKHSSSCLPLPEFVDNTQVPSYCLNARGEGAVRKILLCLANQFPDISFCPALPAVVALLLHYSIDEAECFEKACRILACNDPGRRLIDQSFLAFESSCMTFGDLVNKYCQAAHKLMVAVSEDVLQVYADWQRWLFGELPLCYFARVFDVFLVEGYKVLYRVALAILKFFHKVRAGQPLESDSVKQDIRTFVRDIAKTVSPEKLLEKAFAIRLFSRKEIQLLQMANEKALKQKGITVKQKSPGRCLWHSQERYRHCGHVCHAAGADHEVHHPSGHGWHHRHLRPGGGSPHRQLPE

SEQ ID NO: 75719 - protein, 152 aa, Homo sapiens
  Payload ID: 14975
  Gene Symbol:
  Gene Name: RP11-20I23.3
  ENSP ID: ENSP00000455561
MSESKSGPEYASFFAVMGASAAMVFSGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRA

SEQ ID NO: 75720 - protein, 148 aa, Homo sapiens
  Payload ID: 14976
  Gene Symbol:
  Gene Name: RP11-212D19.4
  ENSP ID: ENSP00000461728
  MOD_RES (1)..(1): Any amino acid
XAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSSRYERTMDNMTSSAQIIQRSFSSPENFQRQAVITLV

SEQ ID NO: 75721 - protein, 130 aa, Homo sapiens
  Payload ID: 14977
  Gene Symbol:
  Gene Name: RP11-214K3.25
  ENSP ID: ENSP00000480330
  MOD_RES (1)..(1): Any amino acid
XAPSAEGCCRRTPPLFDHNKGRILTQQDPKAFVVLQPLWALPLPVLLECLGGFDPVTVIGVAGSRSRSFLDNPPHDWKTTKKPSSFFAVWIQTPGAQACTWAAAPCTWPDIWNMEPRCLGVRELPSRICM

SEQ ID NO: 75722 - protein, 98 aa, Homo sapiens
  Payload ID: 14978
  Gene Symbol:
  Gene Name: RP11-215A19.2
  ENSP ID: ENSP00000422449
  MOD_RES (1)..(1): Any amino acid
XPVLRGDGARPSWLASALACVLIFTIVVDILGNLLVILSVYRNKKLRNAGCQHEDTGCGIRRRCIQLSLQSQDKPAPTHYWLNLTNRYSFVFCFFKCI

SEQ ID NO: 75723 - protein, 153 aa, Homo sapiens
  Payload ID: 14979
  Gene Symbol:
  Gene Name: RP11-216L13.16
  ENSP ID: ENSP00000399627
ALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 75724 - protein, 40 aa, Homo sapiens
  Payload ID: 14980
  Gene Symbol:
  Gene Name: RP11-216L13.17
  ENSP ID: ENSP00000476927
  MOD_RES (1)..(1): Any amino acid
XLGLSRVDDAVAAKHPAPAWPLACRCSFRGSFHTLCSGAS

SEQ ID NO: 75725 - protein, 725 aa, Homo sapiens [sequence omitted]

SEQ ID NO: 75726 - protein, 1425 aa, Homo sapiens; identical to SEQ ID NO: 18368
  Payload ID: 14981
  Gene Symbol:
  Gene Name: RP11-219A15.1
  ENSP ID: ENSP00000440655

SEQ ID NO: 75727 - protein, 108 aa, Homo sapiens
  Payload ID: 14982
  Gene Symbol:
  Gene Name: RP11-229P13.27
  ENSP ID: ENSP00000485208
TNGNRCCAWSGIKSHPRSWTRPPRMRRMRTETSRCTSARAWPRLESPSAAGWRKGPWAQPIVSGVYGHGSGRGKGQSSLHPQFIPGPGPCRGTSGGCRDLRISGLLAD

SEQ ID NO: 75728 - protein, 77 aa, Homo sapiens
  Payload ID: 14982
  Gene Symbol:
  Gene Name: RP11-229P13.27
  ENSP ID: ENSP00000485275
  MOD_RES (1)..(1): Any amino acid
XLGTSGWHRARRCTTTSTNGNRCCAWSGIKSHPRSWTRPPRMRRMRTETSRCTSARAWPRGTSGGCRDLRISGLLAD

SEQ ID NO: 75729 - protein, 420 aa, Homo sapiens [sequence omitted]

SEQ ID NO: 75730 - protein, 595 aa, Homo sapiens
  Payload ID: 14983
  Gene Symbol:
  Gene Name: RP11-231C14.4
  ENSP ID: ENSP00000447597
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECVLTPLPPSADDNLKTPPECVLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAFHPQRMIISRHLPSVSSLPFHPQLHSQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSV

SEQ ID NO: 75731 - protein, 24 aa, Homo sapiens
  Payload ID: 14983
  Gene Symbol:
  Gene Name: RP11-231C14.4
  ENSP ID: ENSP00000449585
  MOD_RES (1)..(1): Any amino acid
XHVKSVTCPCEYLRKVDGRMATWM

SEQ ID NO: 75732 - protein, 49 aa, Homo sapiens; identical to SEQ ID NO: 58201
  Payload ID: 14983
  Gene Symbol:
  Gene Name: RP11-231C14.4
  ENSP ID: ENSP00000449726

SEQ ID NO: 75733 - protein, 40 aa, Homo sapiens; identical to SEQ ID NO: 58208
  Payload ID: 14983
  Gene Symbol:
  Gene Name: RP11-231C14.4
  ENSP ID: ENSP00000449771

SEQ ID NO: 75734 - protein, 78 aa, Homo sapiens
  Payload ID: 14983
  Gene Symbol:
  Gene Name: RP11-231C14.4
  ENSP ID: ENSP00000449864
  MOD_RES (1)..(1): Any amino acid
XLRSICMHTKKRVSSFRGNKIGLKDVITLRRHVETKVRAKIRKRKVTTKINHHDKINGKRKTARKQINHILQKDYACL

SEQ ID NO: 75735 - protein, 68 aa, Homo sapiens; identical to SEQ ID NO: 58228
  Payload ID: 14983
  Gene Symbol:
  Gene Name: RP11-231C14.4
  ENSP ID: ENSP00000449873

SEQ ID NO: 75736 - protein, 250 aa, Homo sapiens [sequence omitted]

SEQ ID NO: 75737 - protein, 849 aa, Homo sapiens
  Payload ID: 14984
  Gene Symbol:
  Gene Name: RP11-231C18.3
  ENSP ID: ENSP00000423325
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 75738 - protein, 83 aa, Homo sapiens
  Payload ID: 14985
  Gene Symbol:
  Gene Name: RP11-234B24.6
  ENSP ID: ENSP00000456318
VVDVSKGIVNAVKDPDANGKSFAFVGPSRYLLFHLVKYIFAVAHRLFLPFPLPLFAYRWVARVFEISPFEPWITRDKVERKKV

SEQ ID NO: 75739 - protein, 478 aa, Homo sapiens
  Payload ID: 14986
  Gene Symbol:
  Gene Name: RP11-235E17.2
  ENSP ID: ENSP00000461416
MAARPITLGIDLGTTSVKAALLRAAPDDPSGFAVLASCARAARAEAAVESAVAGPQGREQDVSRILQALHECLAALPRPQLRSVVGIGVSGQMHGVVFWKTGQGCEWTEGGITPVFEPRAVSHLVTWQDGRCSSEFLASLPQPKSHLSVATGFGCATIFWLLKYRPEFLKSYDAAGTIHDYVVAMLCGLPRPLMSDQNAASWGYFNTQSQSWNVETLRSSGFPVHLLPDIAEPGSVAGRTSHMWFEIPKGTQVGVALGDLQASVYSCMAQRTDAVLNISTSVQLAASMPSGFQPAQTPDPTAPVAYFPYFNRTYLGVAASLNGGNVLATFVHMLVQWMADLGLEVEESTVYSRMIQAAVQQRDTHLTITPTVLGERHLPDQLASVTRISSSDLSLGHVTRALCRGIVQNLHSMLPIQQLQEWGVERVMGSGSALSRNDVLKQEVQRAFPLPMSFGQDVDAAVGAALVMLRRHLNQKES

SEQ ID NO: 75740 - protein, 689 aa, Homo sapiens
  Payload ID: 14987
  Gene Symbol:
  Gene Name: RP11-240B13.2
  ENSP ID: ENSP00000262283
MKFGAVTRIGGPPLGNQSPSSCSLLHEKDPPTTSGPQTDQPKKHLTNFKSATRRVARTQWLTADRQTWASISSVPWAQTISEKKPGGSLWETRSSPPTTAGTEEAMNTTSLLAPAAEIMATPGSPSQASPTLGAFTHGTQTPSPTKATAPRYPQTGDLSAEWPFTAGEEPVLVPRPHQVSRVRSSCCLSPILCSPAMIAFLLTSVLMIPHAGGHPLDTPHLPQELPPGLPNNINITFFSGMFKNVESVAEIFDCLGPHFTWLQAVFTNFPVLIQFVNGMKCVAGLCPRDFEDYGCTCRFEMEGLPVDESDSCCFQHRRCYEEAAEMDCLQDPAKLSTEVNCVSKKIICESKDNCEHLLCTCDKAAIECLARSSLNSSLNLLDTSFCLAQTPETTIKEDLTTLLPRVVPVEPTDTSLTALSGEVAAETEADRLITLSKKKAGHDQEGVGAARATSPPGSAEIVATRVTAKIVTLVPAGIKSLGLAVSSVENDPEETTEKACDRFTFLHLGSGDNMQVMPQLGEMLFCLTSRCPEEFESYGCYCGQEGRGEPRDDLDRCCLSHHCCLEQVRRLGCLLERLPWSPVVCVDHTPKCGGQSLCEKLLCACDQTAAECMTSASFNQSLKSPSRLGCPGQPAACEDSLHPVPAAPTLGSSSEEDSEEDPPQEDLGRAKRFLRKSLGPLGIGPLHGR

SEQ ID NO: 75741 - protein, 723 aa, Homo sapiens
  Payload ID: 14988
  Gene Symbol:
  Gene Name: RP11-244H3.4
  ENSP ID: ENSP00000421752
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLAEQSQQVALTHTVVKLKCQHCNHLFATKPELLFYKGKMFLFCGKNCSDEYKKKNKVVAMCDYCKLQKIIKETVRFSGVDKPFCSEVCKFLSARDFGERWGNYCKMCSYCSQTSPNLVENRLEGKLEEFCCEDCMSKFTVLFYQMAKCDGCKRQGKLSESIKWRGNIKHFCNLFCVLEFCHQQIMNDCLPQNKVNISKAKTAVTELPSARTDTTPVITSVMSLAKIPATLSTGNTNSVLKGAVTKEAAKIIQDESTQEDAMKFPSSQSSQPSRLLKNKGISCKPVTQTKATSCKPHTQHKECQTECPVRAVC

SEQ ID NO: 75742 - protein, 66 aa, Homo sapiens
  Payload ID: 14989
  Gene Symbol:
  Gene Name: RP11-248J23.7
  ENSP ID: ENSP00000473305
  MOD_RES (1)..(1): Any amino acid
XMKKFCAQPWEEIKTSYAGVKEKYLSEYCFSGTYILSLLLQGYHFTADSWEHIHFIGKKVEIKGPS

SEQ ID NO: 75743 - protein, 46 aa, Homo sapiens
  Payload ID: 14990
  Gene Symbol:
  Gene Name: RP11-249C24.12
  ENSP ID: ENSP00000477850
MDPNCSCSTTPANAESANAPPARRAAAPAAPWAVPSVPRDVFAKGH

SEQ ID NO: 75744 - protein, 171 aa, Homo sapiens
  Payload ID: 14991
  Gene Symbol:
  Gene Name: RP11-257K9.8
  ENSP ID: ENSP00000457270
MDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGGSTAWPWERVLSARSRGGPCPKTFILQWCSTWKRTRRSSSSDLMTRTFAALSCTATPLFSWRGVSQLQARHV

SEQ ID NO: 75745 - protein, 278 aa, Homo sapiens
  Payload ID: 14992
  Gene Symbol:
  Gene Name: RP11-26J3.4
  ENSP ID: ENSP00000430858
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKGSPKNVESFASMLRHSPLTQMGPAKDKLVIGRIFHIVENDLYIDFGGKFHCVCRRPEVDGESPISWYAVWRRFSQVMITCFSSNSDFGKHRKR

SEQ ID NO: 75746 - protein, 240 aa, Homo sapiens
  Payload ID: 14993
  Gene Symbol:
  Gene Name: RP11-277P12.6
  ENSP ID: ENSP00000437563
MNKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNFSPNTRTQKARHCGHCPEEWITYSNSCYYIGKERRTWEESLQACASKNSSSLLCIDNEEEMKFLASILPSSWIGVFRNSSHHPWVTINGLAFKHEIKDSDHAERNCAMLHVRGLISDQCGSSRIIRRGFIMLTRLVLNS

SEQ ID NO: 75747 - protein, 154 aa, Homo sapiens
  Payload ID: 14994
  Gene Symbol:
  Gene Name: RP11-286N22.8
  ENSP ID: ENSP00000440219
MLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATEAKPAPEIFENEVMALLRDFAKNKNKEQRLRAPDLEYLFEKPR

SEQ ID NO: 75748 - protein, 133 aa, Homo sapiens
  Payload ID: 14994
  Gene Symbol:
  Gene Name: RP11-286N22.8
  ENSP ID: ENSP00000440939
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGPLGPCPTAS

SEQ ID NO: 75749 - protein, 133 aa, Homo sapiens; identical to SEQ ID NO: 75748
  Payload ID: 14994
  Gene Symbol:
  Gene Name: RP11-286N22.8
  ENSP ID: ENSP00000442581

SEQ ID NO: 75750 - protein, 163 aa, Homo sapiens
  Payload ID: 14994
  Gene Symbol:
  Gene Name: RP11-286N22.8
  ENSP ID: ENSP00000443130
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGTGEKVLYKKMAHSEVELNRPPGALPHSIMMGKLPLGVVS

SEQ ID NO: 75751 - protein, 191 aa, Homo sapiens
  Payload ID: 14995
  Gene Symbol:
  Gene Name: RP11-287D1.3
  ENSP ID: ENSP00000416453
KDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 75752 - protein, 787 aa, Homo sapiens
  Payload ID: 14996
  Gene Symbol:
  Gene Name: RP11-290H9.2
  ENSP ID: ENSP00000456711
  MOD_RES (1)..(1): Any amino acid
XTVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTEILLYYCSFILVHQSLESLRTEFTSKQKDGN

SEQ ID NO: 75753 - protein, 84 aa, Homo sapiens
  Payload ID: 14997
  Gene Symbol:
  Gene Name: RP11-293I14.2
  ENSP ID: ENSP00000454911
FPLDPKRRKEWVRLVRRKNFVPGKHTFLCSKHFEASCFDLTGQTRRLKMDAVPTIFDFCTHIKSMVTYDLFLRGVGCFLLLFLF

SEQ ID NO: 75754 - protein, 313 aa, Homo sapiens; identical to SEQ ID NO: 1183
  Payload ID: 14998
  Gene Symbol:
  Gene Name: RP11-294C11.1
  ENSP ID: ENSP00000479657

SEQ ID NO: 75755 - protein, 117 aa, Homo sapiens
  Payload ID: 14999
  Gene Symbol:
  Gene Name: RP11-294C11.2
  ENSP ID: ENSP00000479937
MKHLWFFLLLVAAPRWVLSQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCAR

SEQ ID NO: 75756 - protein, 316 aa, Homo sapiens
  Payload ID: 15000
  Gene Symbol:
  Gene Name: RP11-294C11.3
  ENSP ID: ENSP00000485668
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYICPFRALPADKMVSLFHTVIFPLMNPMIYTLRNQEVKTSMKRLLSRHVVCQVDFIIRN

SEQ ID NO: 75757 - protein, 211 aa, Homo sapiens
  Payload ID: 15000
  Gene Symbol:
  Gene Name: RP11-294C11.3
  ENSP ID: ENSP00000487127
  MOD_RES (1)..(1): Any amino acid
XLLGLTQSQDIQLLVFVLILIFYLIILPGNFLIIFTIRSDPGLTAPLYLFLGNLAFLDASYSFIVAPRMLVDFLSEKKVIKLACTDMFVVELLMVFNSGLMTLLCFLGLLASYAVILCHVRRAASEGKNKAMSTCTTRVIIILLMFGPAIFIYICPFRALPADKMVSLFHTVIFPLMNPMIYTLRNQEVKTSMKRLLSRHVVCQVDFIIRN

SEQ ID NO: 75758 - protein, 117 aa, Homo sapiens; identical to SEQ ID NO: 39678
  Payload ID: 15001
  Gene Symbol:
  Gene Name: RP11-294C11.4
  ENSP ID: ENSP00000486959

SEQ ID NO: 75759 - protein, 261 aa, Homo sapiens
  Payload ID: 15002
  Gene Symbol:
  Gene Name: RP11-295K3.1
  ENSP ID: ENSP00000415840
MAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKAQGPGQCPAPLGDPASTTDGAQEARVPLDGAFWIPRPPAGSPKGCFACVSKPPALQAPAAPAPEPSASPPMAPTLFPMESKSSKTDSVRAAGAPPACKHLAEKK

SEQ ID NO: 75760 - protein, 34 aa, Homo sapiens
  Payload ID: 15003
  Gene Symbol:
  Gene Name: RP11-295P9.13
  ENSP ID: ENSP00000469146
  MOD_RES (1)..(1): Any amino acid
XTQRKYIQGLKRLMTICQKHFPTDPSKCVEYNAL

SEQ ID NO: 75761 - protein, 18 aa, Homo sapiens
  Payload ID: 15003
  Gene Symbol:
  Gene Name: RP11-295P9.13
  ENSP ID: ENSP00000469443
CQKHFPTDPSKCVEYNAL

SEQ ID NO: 75762 - protein, 203 aa, Homo sapiens
  Payload ID: 15003
  Gene Symbol:
  Gene Name: RP11-295P9.13
  ENSP ID: ENSP00000473200
  MOD_RES (1)..(1): Any amino acid
XNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTMVGIHARTGREKIFSKHVAHVLNDETQRKYIQDLNVYDTLSS

SEQ ID NO: 75763 - protein, 109 aa, Homo sapiens
  Payload ID: 15004
  Gene Symbol:
  Gene Name: RP11-296A16.1
  ENSP ID: ENSP00000415219
  MOD_RES (1)..(1): Any amino acid
XMPSGLCAHLFGLSDCPVLSGSGAVYRVCAGTATFHLLQAVLLVHLHSPTSPRAQLHNSMALHWHLWRLCIHPTAVGAYYSFCPFLEQELSNPALASYKLLSSAAISCI

SEQ ID NO: 75764 - protein, 193 aa, Homo sapiens
  Payload ID: 15005
  Gene Symbol:
  Gene Name: RP11-298I3.5
  ENSP ID: ENSP00000450856
  MOD_RES (1)..(1): Any amino acid
XLGEKASRLLEKFGRRKDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 75765 - protein, 3053 aa, Homo sapiens
  Payload ID: 15006
  Gene Symbol:
  Gene Name: RP11-2C24.9
  ENSP ID: ENSP00000369719
VSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQAGEVVSIGQLASLAQRPVANAGGSKPLTFQIQGNKLTLTGAQVRQLAVGQPRPLQMPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 75766 - protein, 210 aa, Homo sapiens
  Payload ID: 15007
  Gene Symbol:
  Gene Name: RP11-302B13.5
  ENSP ID: ENSP00000438507
MGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDGHDLGSLQPPPPGFKQFSCLSLPSVHFYKPSSEPLGSPRSSKREPRSLSGTSLTDMSKLSVTGGNPEVLTTGFVEGSRVRS

SEQ ID NO: 75767 - protein, 52 aa, Homo sapiens
  Payload ID: 15008
  Gene Symbol:
  Gene Name: RP11-302M6.4
  ENSP ID: ENSP00000359482
MIPVTEFRQFSEQQPAFRVLKPWWDVFTDYLSVAMLMIGVFGCTLQEVHGCL

SEQ ID NO: 75768 - protein, 1105 aa, Homo sapiens
  Payload ID: 15009
  Gene Symbol:
  Gene Name: RP11-307N16.6
  ENSP ID: ENSP00000371576
MTQAAVRPWAPCLENMTTAPNGLGPGPAAPCAGSDLKDAKMVTSLACGNGVCGCSPGGDTDTQEAKLSPAKLVRLFSTSRKRTGAHPERPHSMVLVGNSSTWNTLASFRKMGSFKKLKSSVLKGIQSREGSNACSKGEASEHGLGKSIPNGAVPGAQASRGSPLAPGPACGALRPAEWGTLDGSDLEDTDDAFQRSTHRSRSLRRAYGLGRICLLDAPQNHATPTIATGQVPAVCEILVRDPENNSMGYRRSKSTDNLAFLKKSSFKRKSTSNLADLRTAHDARVPQRTLSSSSTDSQKLGSGRTKRWRSPIRAKDFDRVFKLVSNVTEAAWRRESPRSGAPSPGEASLRLQAHSRLHDDYSRRVSRSTEQDSRRGGAVMHGTTATCTVAPGFGSATSKGPHLDADTAVFPLETKSSWAVESDSSCTCSSLPSPIVQDVLSKDSCDPNAGSQLTFDPEQPPTPLRPTTPKPQSPQSPQSPGAGSASCHSNHSALSANSEESEGRAEEPAQREPGPVSLQDPLEATHGDEGSKDLLVNIGVAAGPEEKEKEEPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKVQSLSSEP

SEQ ID NO: 75769 - protein, 243 aa, Homo sapiens
  Payload ID: 15010
  Gene Symbol:
  Gene Name: RP1-130H16.18
  ENSP ID: ENSP00000331267
ELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRGASSSA

SEQ ID NO: 75770 - protein, 233 aa, Homo sapiens
  Payload ID: 15010
  Gene Symbol:
  Gene Name: RP1-130H16.18
  ENSP ID: ENSP00000400319
GKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQESCPHLSSCK

SEQ ID NO: 75771 - protein, 480 aa, Homo sapiens
  Payload ID: 15010
  Gene Symbol:
  Gene Name: RP1-130H16.18
  ENSP ID: ENSP00000401535
GKVKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVVELPVTERQIEREHLIQLRRWQETRELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHRFPSDLLLTSSSGELWRMVRIGGQPLGFDECGIVAQIAGPLAAADISAYYISTFNFDHALVPEDGIGSVIEVLQRRQEGLAS

SEQ ID NO: 75772 - protein, 233 aa, Homo sapiens; identical to SEQ ID NO: 75770
  Payload ID: 15010
  Gene Symbol:
  Gene Name: RP1-130H16.18
  ENSP ID: ENSP00000406516

SEQ ID NO: 75773 - protein, 232 aa, Homo sapiens
  Payload ID: 15010
  Gene Symbol:
  Gene Name: RP1-130H16.18
  ENSP ID: ENSP00000415854
VKLQQNPGKFDELDMSPGDPKWLDVIERDLHRQFPFHEMFVSRGGHGQQDLFRVLKAYTLYRPEEGYCQAQAPIAAVLLMHMPAEQAFWCLVQICEKYLPGYYSEKLEAIQLDGEILFSLLQKVSPVAHKHLSRQKIDPLLYMTEWFMCAFSRTLPWSSVLRVWDMFFCEGVKIIFRVGLVLLKHALGSPEKVKACQGQYETIERLRSLSPKIMQEAFLVQEVQVLQPDGDP

SEQ ID NO: 75774 - protein, 208 aa, Homo sapiens
  Payload ID: 15011
  Gene Symbol:
  Gene Name: RP11-310N16.1
  ENSP ID: ENSP00000473498
MKQRFSALQLLKLLLLLQPPLPRALREALCPEPCNCVPDGALRCPGPTAGLTRLSLAYLPVKVIPSQAFRGLNEVIKILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLPCRAMA

SEQ ID NO: 75775 - protein, 116 aa, Homo sapiens
  Payload ID: 15012
  Gene Symbol:
  Gene Name: RP11-314N13.10
  ENSP ID: ENSP00000479180
MGVQVETISPGDGRTFPKRGQTCVVHYTGCGQFWPSCSRISSTFLFQIMETWRDPSIEGNDFHWKEEKGVLRISHVIPVPISRGPKSGPSHSGPGQSLTQDASPASPGNSHFPTTR

SEQ ID NO: 75776 - protein, 92 aa, Homo sapiens
  Payload ID: 15013
  Gene Symbol:
  Gene Name: RP11-315D16.2
  ENSP ID: ENSP00000456336
MEATRRRQHLGATGGPGAQLGASFLQARRKWRAGFLHFSDHYAHANKTRRPKERNSSSHVDGGQGEERLRHGVRPAVKTHESGGEAHPQGSG

SEQ ID NO: 75777 - protein, 100 aa, Homo sapiens
  Payload ID: 15014
  Gene Symbol:
  Gene Name: RP11-318A15.7
  ENSP ID: ENSP00000466829
IGAGVSLPGILAAKCGAEVILSDSSELPHCLEVCRQSCQMNNLPHLQVVGLTWGHISWDLLALPPQDIILASDVFFEPEGLSVASPRGELTALGCCLRQS

SEQ ID NO: 75778 - protein, 97 aa, Homo sapiens
  Payload ID: 15015
  Gene Symbol:
  Gene Name: RP11-321N4.5
  ENSP ID: ENSP00000426494
  MOD_RES (1)..(1): Any amino acid
XYYDYYGYDYHNYRGGYEDPYYGYEDFQVGARGRGGRGARGAAPSRGRGAAPPRGRAGYSQRGGPGSARGVRGARGGAQQQRGRGGKGVEAGPDLLQ

SEQ ID NO: 75779 - protein, 123 aa, Homo sapiens
  Payload ID: 15016
  Gene Symbol:
  Gene Name: RP11-322E11.6
  ENSP ID: ENSP00000467041
MAAQIPIVATTSTPGIVRNSKKRPASPSHNGSSGGGYGASKKKKASASSFAQVPGLGEPGGEGTDYLKITWRRSLIQAQAPRKGHARTQGEGQLSVSQKEPSLETKSARTFILDFPAFRDVKK

SEQ ID NO: 75780 - protein, 95 aa, Homo sapiens
  Payload ID: 15017
  Gene Symbol:
  Gene Name: RP11-322N21.2
  ENSP ID: ENSP00000480059
MGPSRLVRGPRPQGMRSPYRRPGMGWPRPRFPRMFKCSRRRYQQGLRGRTASSAAINPATRAMGINNTHTDTTIVWIFPPQVLRHLRQPGIFLIL

SEQ ID NO: 75781 - protein, 1186 aa, Homo sapiens
  Payload ID: 15018
  Gene Symbol:
  Gene Name: RP11-330H6.5
  ENSP ID: ENSP00000417517
  MOD_RES (1)..(1): Any amino acid
XCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVVFIYSMPGYKCSIKERMLYSSCKSRLLDSVEQDFHLEIAKKGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 75782 - protein, 55 aa, Homo sapiens
  Payload ID: 15018
  Gene Symbol:
  Gene Name: RP11-330H6.5
  ENSP ID: ENSP00000419980
  MOD_RES (1)..(1): Any amino acid
XSMPGYKCSIKERMLYSSCKSRLLDSVEQDFHLEIAKKPLLPLWEGTSSVKHPSL

SEQ ID NO: 75783 - protein, 103 aa, Homo sapiens
  Payload ID: 15019
  Gene Symbol:
  Gene Name: RP11-33O4.2
  ENSP ID: ENSP00000320919
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGCLLSRLHP

SEQ ID NO: 75784 - protein, 428 aa, Homo sapiens
  Payload ID: 15020
  Gene Symbol:
  Gene Name: RP11-343C2.11
  ENSP ID: ENSP00000461295
LYRYPFERLKMSADDGIRNLYLDFGGPEGELKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQMQGVGNNNDGTLVLGATNIPWVLDSAIRRRFEKRIYIPLPEEAARAQMFRLHLGSTPHNLTDANIHELARKTEGYSGADISIIVRDSLMQPVRKVQSATHFKKVCGPSRTNPSMMIDDLLTPCSPGDPGAMEMTWMDVPGDKLLEPVVCM

SEQ ID NO: 75785 - protein, 164 aa, Homo sapiens
  Payload ID: 15021
  Gene Symbol:
  Gene Name: RP11-343C2.12
  ENSP ID: ENSP00000457718
SFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKGWTPMENRWCGRRAGGQPASSSTRWTTCRAACLLTKWTAGRSQTSIG

SEQ ID NO: 75786 - protein, 172 aa, Homo sapiens
  Payload ID: 15022
  Gene Symbol:
  Gene Name: RP11-343C2.7
  ENSP ID: ENSP00000462747
  MOD_RES (1)..(1): Any amino acid
XGLVVLNLVTSARSQKTEPLSGSGDQPLFRGADRYDFAIMIPPGGTECFWQFAHQTGYFYFSYEVQRTVGMSHDRHVAATAHNPQGFLIDTSQGVRGQINFSTQETGFYQLCLSNQHNHFGSVQVYLNFGVFYEGPETDHKQKERKQLNDTLDAIEELCEGSRGDQLQPPDE

SEQ ID NO: 75787 - protein, 108 aa, Homo sapiens
  Payload ID: 15022
  Gene Symbol:
  Gene Name: RP11-343C2.7
  ENSP ID: ENSP00000464417
GLVVLNLVTSARSQKTEPLSGSGDQPLFRGADRYDFAIMIPPGGTECFWQFAHQTGYFYFSYEVQRTVGMSHDRHVAATAHNPQGFLIDTSQGVRGQINFSTQETGTL

SEQ ID NO: 75788 - protein, 156 aa, Homo sapiens
  Payload ID: 15023
  Gene Symbol:
  Gene Name: RP11-343C2.9
  ENSP ID: ENSP00000454500
MNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVH

SEQ ID NO: 75789 - protein, 132 aa, Homo sapiens
  Payload ID: 15024
  Gene Symbol:
  Gene Name: RP11-345J4.3
  ENSP ID: ENSP00000446698
  MOD_RES (1)..(1): Any amino acid
XLLSHRRTGSSLPASAEPWPRNCLKARPLHLPTSGPASSPVAKIAGLYNDLEPPRKTMRRGVLMTLLQQSAMTLPLWIGKPGDKPPPLCGAIPASGDYVARPGDKVAARVKAVDGDEQWILAEVVSYSHATN

SEQ ID NO: 75790 - protein, 143 aa, Homo sapiens
  Payload ID: 15024
  Gene Symbol:
  Gene Name: RP11-345J4.3
  ENSP ID: ENSP00000447361
RPRRMGSRARRAQSPWGGQQECSCEPRRALPPAQPSIAGPLLSHRRTGSSLPASAEPWPRNCLKARPLHLPTSGPASSPVAKIAGLYNDLEPPRKTMRRGVLMTLLQQSAMTLPLWIGKPGDKRLRGQTWRQGGCPGEGRGWG

SEQ ID NO: 75791 - protein, 439 aa, Homo sapiens
  Payload ID: 15024
  Gene Symbol:
  Gene Name: RP11-345J4.3
  ENSP ID: ENSP00000449334
MRAAPRQFSTQRQGLAVSPRLECNGVIIAHFSLQLLGSSDPPTSASPVAGTTGICHHARLLRAAILNWEPGKTSLWRWQVIKTEDVEKNLPVKGKRQVLLCSGMARSTIIHPHLRDVDRAATVSGRFLAPQQQDPKSSGGCAALLGADLPWSAPPLERADAQGAHSPLGPRDRLRLRLGVSKGTCAAPWGGGGPTVSGQCRAADGGRGATGPGGAPRAGVPGPLQPRRGWSQGGSGRGSDPKSRPQAAARSSSLPEGRPRRMGSRARRAQSPWGGQQECSCEPRRALPPAQPSIAGPLLSHRRTGSSLPASAEPWPRNCLKARPLHLPTSGPASSPVAKIAGLYNDLEPPRKTMRRGVLMTLLQQSAMTLPLWIGKPGDKPPPLCGAIPASGDYVARPGDKPQEDYSILFEDTSYADGYSPHLSVAQRYLVASKEPKKK

SEQ ID NO: 75792 - protein, 89 aa, Homo sapiens
  Payload ID: 15025
  Gene Symbol:
  Gene Name: RP11-345J4.5
  ENSP ID: ENSP00000457350
  MOD_RES (1)..(1): Any amino acid
XFPAEVAPVRQQGSVAGARAGVVSLLGCRSSWTAAMELSAEYLREKLQRDLEAEHVEVEDTTLNRCSCSFRVLVVSAKFEGKPLLQRHR

SEQ ID NO: 75793 - protein, 124 aa, Homo sapiens
  Payload ID: 15025
  Gene Symbol:
  Gene Name: RP11-345J4.5
  ENSP ID: ENSP00000457792
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRFCTE

SEQ ID NO: 75794 - protein, 249 aa, Homo sapiens
  Payload ID: 15025
  Gene Symbol:
  Gene Name: RP11-345J4.5
  ENSP ID: ENSP00000458075
  MOD_RES (1)..(1): Any amino acid
XEVAPVRQQGSVAGARAGVVSLLGCRSSWTAAMELSAEYLREKLQRDLEAEHVEVEDTTLNRCSCSFRVLVVSAKFEGKPLLQRHSLDPSMTIHCDMVITYGLDQLENCQTCGTDYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSSL

SEQ ID NO: 75795 - protein, 143 aa, Homo sapiens
  Payload ID: 15026
  Gene Symbol:
  Gene Name: RP11-347C12.3
  ENSP ID: ENSP00000447453
RPRRMGSRARRAQSPWGGEQECSCEPRRALPPAQPSIAGPLLSHRRTGSSLPASAEPWPRNCLKARPLHLPTSGPASSPVAKIAGLYNDLEPPRKTMRRGVLMTLLQQSAMTLPLWIGKPGDKRLRGQTWRQGGCPGEGRGWG

SEQ ID NO: 75796 - protein, 439 aa, Homo sapiens
  Payload ID: 15026
  Gene Symbol:
  Gene Name: RP11-347C12.3
  ENSP ID: ENSP00000449223
MRAAPRQFSTQRQGLAVSPRLECNGVIIAHFSLQLLGSSDPPTSASPVAGTTGICHHARLLRAAILNWEPGKTSLWRWQVIKTEDVEKNLPVKGKRQVLLCSGMARSTIIHPHLRDVDRAATVSGRFLAPQQQDPKSSGGCAALLGADLPWSAPPLERADAQGAHSPLGPRDRLRLRLGVSKGTCAAPWGGGGPTVSGQCRAADGGRGATGPGGAPRAGVPGPLQPRRGWSQGGSGRGSDPKSRPQAAARSSSLPEGRPRRMGSRARRAQSPWGGEQECSCEPRRALPPAQPSIAGPLLSHRRTGSSLPASAEPWPRNCLKARPLHLPTSGPASSPVAKIAGLYNDLEPPRKTMRRGVLMTLLQQSAMTLPLWIGKPGDKPPPLCGAIPASGDYVARPGDKPQEDYSILFEDTSYADGYSPHLSVAQRYLVASKEPKKK

SEQ ID NO: 75797 - protein, 154 aa, Homo sapiens
  Payload ID: 15026
  Gene Symbol:
  Gene Name: RP11-347C12.3
  ENSP ID: ENSP00000454904
  MOD_RES (1)..(1): Any amino acid
XLLSHRRTGSSLPASAEPWPRNCLKARPLHLPTSGPASSPVAKIAGLYNDLEPPRKTMRRGVLMTLLQQSAMTLPLWIGKPGDKPPPLCGAIPASGDYVARPGDKVAARVKAVDGDEQWILAEVVSYSHATNKHLLCRRLLPSSQCGPEVPGSF

SEQ ID NO: 75798 - protein, 33 aa, Homo sapiens
  Payload ID: 15027
  Gene Symbol:
  Gene Name: RP11-350O14.18
  ENSP ID: ENSP00000480768
  MOD_RES (1)..(1): Any amino acid
XLGLTYLSLLLIPAAGASSCPRTPLPAMAPLPQ

SEQ ID NO: 75799 - protein, 90 aa, Homo sapiens
  Payload ID: 15028
  Gene Symbol:
  Gene Name: RP11-371E8.4
  ENSP ID: ENSP00000451352
MMNFRQRMGWIGVGLYLLASAAAFYYVFEISETYNRLALEHIQQHPEEPLEGTTWTHSLKAQLLSLPFWVWTVIFLKSESFLATSSFHYI

SEQ ID NO: 75800 - protein, 166 aa, Homo sapiens
  Payload ID: 15028
  Gene Symbol:
  Gene Name: RP11-371E8.4
  ENSP ID: ENSP00000451369
MMNFRQRMGWIGVGLYLLASAAAFYYVFEISETYNRLALEHIQQHPEEPLEGTTWTHSLKAQLLSLPFWGSVKRQALYACSTCTPEGEEPAGICLACSYECHGSHKLFELYTKRNFRCDCGNSKFKNLECKLLPDKAKVNSGNKYNDNFFGLYCICKRPYPDPEDE

SEQ ID NO: 75801 - protein, 90 aa, Homo sapiens; identical to SEQ ID NO: 75799
  Payload ID: 15028
  Gene Symbol:
  Gene Name: RP11-371E8.4
  ENSP ID: ENSP00000486673

SEQ ID NO: 75802 - protein, 166 aa, Homo sapiens; identical to SEQ ID NO: 75800
  Payload ID: 15028
  Gene Symbol:
  Gene Name: RP11-371E8.4
  ENSP ID: ENSP00000486968

SEQ ID NO: 75803 - protein, 953 aa, Homo sapiens
  Payload ID: 15029
  Gene Symbol:
  Gene Name: RP11-385D13.1
  ENSP ID: ENSP00000402644
MAELDLMAPGPLPRATAQPPAPLSPDSGSPSPDSGSASPVEEEDVGSSEKLGRETEEQDSDSAEQGDPAGEGKEVLCDFCLDDTRRVKAVKSCLTCMVNYCEEHLQPHQVNIKLQSHLLTEPVKDHNWRYCPAHHSPLSAFCCPDQQCICQDCCQEHSGHTIVSLDAARRDKEAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRVLLRFRRPSLGTGFCLVSLSDLLPGFPPSLQPLPPFQGPPLQPQMKDGRKGLNQDITDVCFSPEKDHSSKSATSQVYWTAKTQHTSLPLSKAPENEHFLGAASNPEEPWRNSLRCISEMNRLFSGKADITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLMEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKLELNNQSKCLAHSQGSTALPCTSARSL

SEQ ID NO: 75804 - protein, 235 aa, Homo sapiens; identical to SEQ ID NO: 65458
  Payload ID: 15030
  Gene Symbol:
  Gene Name: RP11-385J1.3
  ENSP ID: ENSP00000483415

SEQ ID NO: 75805 - protein, 75 aa, Homo sapiens
  Payload ID: 15031
  Gene Symbol:
  Gene Name: RP1-138B7.6
  ENSP ID: ENSP00000480114
HQSLFMSALSAHPDRSLSVCWEQHCKLLPGVAGISASTVAKWTIDEVFGFVQTLTGCEDQARLFKDESCLIIATE

SEQ ID NO: 75806 - protein, 131 aa, Homo sapiens
  Payload ID: 15032
  Gene Symbol:
  Gene Name: RP11-38C17.1
  ENSP ID: ENSP00000387111
MAGILRLVVQWPPGRLQTVTKGVESLICTDWIRHKFTRSRIPEKVFQASPEDHEKYGGDPQNPHKLHIVTRIKSTRRRPYWEKDIIKMLGLEKAHTPQVHKNIPSVNAKLKVVKHLIRFVVSSQLFLKCIA

SEQ ID NO: 75807 - protein, 127 aa, Homo sapiens
  Payload ID: 15033
  Gene Symbol:
  Gene Name: RP1-139D8.6
  ENSP ID: ENSP00000362054
MGRKEHESPSQPHMCGWEDSQKPSVPSHGPKTPSCKGVKAPHSSRPRAWKQDLEQSLAAAYVPVVVDSKGQNPDKLRFNFYTSQYSNSLNPFYTLQKPTCGYLYRRDTDHTRKRFDVPPANLVLWRS

SEQ ID NO: 75808 - protein, 112 aa, Homo sapiens
  Payload ID: 15033
  Gene Symbol:
  Gene Name: RP1-139D8.6
  ENSP ID: ENSP00000485219
MCKDSQKPSVPSHGPKTPSCKGVKAPHSSRPRAWKQDLEQSLAAAYVPVVVDSKGQNPDKLRFNFYTSQYSNSLNPFYTLQKPTCGYLYRRDTDHTRKRFDVPPANLVLWRS

SEQ ID NO: 75809 - protein, 334 aa, Homo sapiens
  Payload ID: 15034
  Gene Symbol:
  Gene Name: RP11-400G3.5
  ENSP ID: ENSP00000483243
KEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAALKNLWPCVHSVFWPGTHGGAAWI

SEQ ID NO: 75810 - protein, 73 aa, Homo sapiens
  Payload ID: 15035
  Gene Symbol:
  Gene Name: RP11-403P17.5
  ENSP ID: ENSP00000462196
  MOD_RES (1)..(1): Any amino acid
XNPETCYQRLKKRCREEEKVIPLEYLEAIHHLHEEWLIKGSLFPMAAPVLRSLQRHNKQAGRRDGRPGELHVP

SEQ ID NO: 75811 - protein, 75 aa, Homo sapiens
  Payload ID: 15036
  Gene Symbol:
  Gene Name: RP11-404P21.8
  ENSP ID: ENSP00000450984
MFSPWKISMFLSVREDSVPTTASFRVSVRRPRLKCSGTIIARCSLDLPGLNDSPTSASRVAGTTGHCAWHHPGPL

SEQ ID NO: 75812 - protein, 1339 aa, Homo sapiens
  Payload ID: 15037
  Gene Symbol:
  Gene Name: RP11-407N17.3
  ENSP ID: ENSP00000452252
MAKFGVHRILLLAISLTKCLESTKLLADLKKCGDLECEALINRVSAMRDYRGPDCRYLNFTKGEEISVYVKLAGEREDLWAGSKGKEFGYFPRDAVQIEEVFISEEIQMSTKESDFLCLLGVSYTFDNEDSELNGDYGENIYPYEEDKDEKSSIYESDFQIEPGFYATYESTLFEDQVPALEAPEDIGSTSESKDWEEVVVESMEQDRIPEVHVPPSSAVSGVKEWFGLGGEQAEEKAFESVIEPVQESSFRSRKIAVEDENDLEELNNGEPQTEHQQESESEIDSVPKTQSELASESEHIPKPQSTGWFGGGFTSYLGFGDEDTGLELIAEESNPPLQDFPNSISSDKEATVPCTEILTEKKDTITNDSLSLKPSWFDFGFAILGFAYAKEDKIMLDDRKNEEDGGADEHEHPLTSELDPEKEQEIETIKIIETEDQIDKKPVSEKTDESDTIPYLKKFLYNFDNPWNFQNIPKETELPFPKQILDQNNVIENEETGEFSIDNYPTDNTKVMIFKSSYSLSEDASEFQILKYLFQIDVYDFMNSAFSPIVILTERVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 75813 - protein, 347 aa, Homo sapiens
  Payload ID: 15038
  Gene Symbol:
  Gene Name: RP11-407P15.2
  ENSP ID: ENSP00000456868
MVQASGHRRSTRGSKMVSWSVIAKIQEIWCEEDERKMVREFLAEFMSTYVMMVFGLGSVAHMVLNKTYGSYLGVNLGFGFGVTMGVHVAGRISGAHMNAAVTFTNCALGRVPWRKFPVHVLGQFLGSFLAAATIYICVSAAAILHFSGGELMVTGPFATAGIFATYLPDHMTLWRGFLNEEWLTRMLQLCLFTITDQENNPALPGTHALVISILVVIIRVSHGINTGYAINPSRDPPPSIFTFIAGWGKQVFSDGENWWWVPVVAPLLGASLGGIIYLVFIGSTIPREPLKLEDSVAYEDHGITVLPKMGSHEPMISPLTLISVSLANRSSVHSAPPLHESMALEHF

SEQ ID NO: 75814 - protein, 107 aa, Homo sapiens
  Payload ID: 15039
  Gene Symbol:
  Gene Name: RP11-411B6.6
  ENSP ID: ENSP00000455090
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLNWGEPDRP

SEQ ID NO: 75815 - protein, 159 aa, Homo sapiens
  Payload ID: 15039
  Gene Symbol:
  Gene Name: RP11-411B6.6
  ENSP ID: ENSP00000455597
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVDRP

SEQ ID NO: 75816 - protein, 71 aa, Homo sapiens; identical to SEQ ID NO: 55143
  Payload ID: 15039
  Gene Symbol:
  Gene Name: RP11-411B6.6
  ENSP ID: ENSP00000456355

SEQ ID NO: 75817 - protein, 71 aa, Homo sapiens; identical to SEQ ID NO: 55143
  Payload ID: 15039
  Gene Symbol:
  Gene Name: RP11-411B6.6
  ENSP ID: ENSP00000456407

SEQ ID NO: 75818 - protein, 172 aa, Homo sapiens; identical to SEQ ID NO: 55141
  Payload ID: 15039
  Gene Symbol:
  Gene Name: RP11-411B6.6
  ENSP ID: ENSP00000456832

SEQ ID NO: 75819 - protein, 248 aa, Homo sapiens
  Payload ID: 15040
  Gene Symbol:
  Gene Name: RP11-426L16.10
  ENSP ID: ENSP00000475703
  MOD_RES (1)..(1): Any amino acid
XEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSSPTMAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFC

SEQ ID NO: 75820 - protein, 33 aa, Homo sapiens
  Payload ID: 15040
  Gene Symbol:
  Gene Name: RP11-426L16.10
  ENSP ID: ENSP00000476038
  MOD_RES (1)..(1): Any amino acid
XEFTHLEFPRRVLPKELGQRMLYRDQNMTGWLG

SEQ ID NO: 75821 - protein, 271 aa, Homo sapiens
  Payload ID: 15040
  Gene Symbol:
  Gene Name: RP11-426L16.10
  ENSP ID: ENSP00000476252
  MOD_RES (1)..(1): Any amino acid
XEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSSLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFC

SEQ ID NO: 75822 - protein, 948 aa, Homo sapiens
  Payload ID: 15041
  Gene Symbol:
  Gene Name: RP11-432B6.3
  ENSP ID: ENSP00000456272
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQKKKSFLTALCDVGNLINQEYTPQIERMKEIREQQLELMALTISLQEESPLKFLEKVDDVRQHVQILKQRPLPEVQPVEIYPRVSKILKEEWSRTEIGQIKNVLIPKMKISPKRMSCSWPGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTGWSYALEKPNTGSIFNIAWSIDGTQIAGACGNGHVVFAHVVEQHWEWKNFQVTLTKRRAMQVRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKIIFLFEASTGKPLGDGKFLSHKNEILEIALDQKGLTNDRKIAFIDKNRDLCITSVKRFGKEEQIIKLGTMVHTLAWNDTCNILCGLQDTRFIVWYYPNTVYVDRDILPKTLYERDASEFSKNPHIVSFVGNQVTIRRADGSLVHISITPYPAILHEYVSSSKWEDAVRLCRFVKEQTMWACLAAMAVANRDMTTAEIAYAAIGEIDKVQYINSIKNLPSKESKMAHILLFSGNIQEAEIVLLQAGLVYQAIQININLYNWERALELAVKYKTHVDTVLAYRQKFLETFGKQETNKRYLHYAEGLQIDWEKIKAKIEMEITKEREQSSSSQSSKSIGLKP

SEQ ID NO: 75823 - protein, 133 aa, Homo sapiens
  Payload ID: 15042
  Gene Symbol:
  Gene Name: RP11-434D12.1
  ENSP ID: ENSP00000476275
  MOD_RES (1)..(1): Any amino acid
XGPAHVVTVIARQRGDQLVPFSTKSGDTLLLLHHGDFSAEEVFHRELRSNSMKTWGLRAAGWMAMFMGLNLMTRILYTLAFFRLLSPQNVTWKTRSQQMTCTSLLSPLLQRGSEGSISKPDSGEGKWPAEKWS

SEQ ID NO: 75824 - protein, 360 aa, Homo sapiens
  Payload ID: 15043
  Gene Symbol:
  Gene Name: RP11-435I10.4
  ENSP ID: ENSP00000454253
MLSAAHDILSHKRTSGNQSHAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 75825 - protein, 127 aa, Homo sapiens
  Payload ID: 15044
  Gene Symbol:
  Gene Name: RP11-437B10.1
  ENSP ID: ENSP00000486623
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEE

SEQ ID NO: 75826 - protein, 111 aa, Homo sapiens
  Payload ID: 15045
  Gene Symbol:
  Gene Name: RP11-438J1.1
  ENSP ID: ENSP00000399689
QKEDDVACSRRLSWGSSRRRNNSSSSFSPHFLGPGVGGAASKGCLIRNTRGFLSSGGSPLRPANASLEEMASLEEEACSLKLKLRVRMIQLRNPTRSRKGRGIDFETRAPQ

SEQ ID NO: 75827 - protein, 665 aa, Homo sapiens
  Payload ID: 15045
  Gene Symbol:
  Gene Name: RP11-438J1.1
  ENSP ID: ENSP00000402783
QKEDDVACSRRLSWGSSRRRNNSSSSFSPHFLGPGVGGAASKGCLIRNTRGFLSSGGSPLRPANASLEEMASLEEEACSLKVDSKDSSHNSTNSEFAAEAEGQNDTIEEPNKVQKRKRDRLRDQGSTMIYLKAIQGILGKSMPKRKGEAATRAKPSAAEHPSHGEGPARSEGPAKTAEGAARSVTVTAAQKEKDATPEVSMEEDKTVPERSSFYDRRVVIDPQEKPSEEPLGDRRTVIDKCSPPLEFLDDSDSHLEIQKHKDREVVMEHPSSGSDWSDVEEISTVRFSQEEPVSLKPSAVPEPSSFTTDYVMYPPHLYSSPWCDYASYWTSSPKPSSYPSTGSSSNDAAQVGKSSRSRMSDYSPNSTGSVQNTSRDMEASEEGWSQNSRSFRFSRSSEEREVKEKRTFQEEMPPRPCGGHASSSLPKSHLEPSLEEGFIDTHCHLDMLYSKLSFQGTFTKFRKIYSSSFPKEFQGCISDFCDPRTLTDCLWEELLKEDLVWGAFGCHPHFARYYSESQERNLLQALRHPKAVAFGEMGLDYSYKCTTPVPEQHKVFERQLQLAVSLKKPLVIHCREADEDLLEIMKKFVPPDYKIHRHCFTGSYPVIEPLLKYFPNMSVGFTAVLTYSSAWEAREALRQIPLERIIVETDAPYFLPRQAVQSPTL

SEQ ID NO: 75828 - protein, 135 aa, Homo sapiens
  Payload ID: 15046
  Gene Symbol:
  Gene Name: RP11-444E17.6
  ENSP ID: ENSP00000424257
  MOD_RES (1)..(1): Any amino acid
XRLTFSSAYQGNSLMYHDSPCSNGYVYIPLAFLLMLYAVYLVECWHCQARHELQHRVDVSSVRERVGRMQQATPCIWWKAISYHYVRRTRQVTRYRNGDAYTTTQVPGCLGSQVVPLRSPWRNAQLDAGSDEEPA

SEQ ID NO: 75829 - protein, 70 aa, Homo sapiens; identical to SEQ ID NO: 21719
  Payload ID: 15047
  Gene Symbol:
  Gene Name: RP11-446E24.4
  ENSP ID: ENSP00000457656

SEQ ID NO: 75830 - protein, 106 aa, Homo sapiens
  Payload ID: 15048
  Gene Symbol:
  Gene Name: RP11-447L10.1
  ENSP ID: ENSP00000405181
MATSIGVSFSVGDGVPEAEKNAGEPENTYILRPVFQQRFRPSVVKDCIHAVLKEELANAEYSPEEMPQLTKHLSENIKDKLKEMGFDRYKMVVQVVIGEQRGEGVF

SEQ ID NO: 75831 - protein, 1027 aa, Homo sapiens
  Payload ID: 15049
  Gene Symbol:
  Gene Name: RP11-449H3.3
  ENSP ID: ENSP00000475384
MLIEDVDALKSWLAKLLEPICDADPSALANYVVALVKKDKPEKELKAFCADQLDVFLQKETSGFVDKLFESLYTKNYLPLLEPVKPEPKPLVQEKEEIKEEVFQEPAEEERDGRKKKYPSPQKTRSESSERRTREKKREDGKWRDYDRYYERNELYREKYDWRRGRSKSRSKSRGLSRSRSRSRGRSKDRDPNRNVEHRERSKFKSERNDLESSYVPVSAPPPNSSEQYSSGAQSIPSTVTVIAPAHHSENTTESWSNYYNNHSSSNSFGRNLPPKRRCRDYDERGFCVLGDLCQFDHGNDPLVVDEVALPSMIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSEHTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQVAFKGDPEAALIQYLTNEEARKAISSTEAVLNNRFIRVLWHRENNEQPTLQSSAQLLLQQQQTLSHLSQQHHHLPQHLHQQQVLVAQSAPSTVHGGIQKMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSMEFCSCCPGWSAMVRSRLTATSASLVQVILLPQPPKQLRLQEREDDGHELQAAFRHAPGAARTQILQSALWLRGHAPSLSPSPAGT

SEQ ID NO: 75832 - protein, 238 aa, Homo sapiens
  Payload ID: 15050
  Gene Symbol:
  Gene Name: RP11-458D21.5
  ENSP ID: ENSP00000483006
MCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPDGYLARWPHSASLLSESELLAVLSALS

SEQ ID NO: 75833 - protein, 95 aa, Homo sapiens
  Payload ID: 15051
  Gene Symbol:
  Gene Name: RP11-45M22.4
  ENSP ID: ENSP00000394249
MNAIVALCHFCELHGPRTLFCTEVLHAPLPQGDGNEDSPGQGEQAEEEEAASLQVPPAHEAGPGCPFFPHAGLARSHGEPGDLEKQRRGPRPVSF

SEQ ID NO: 75834 - protein, 57 aa, Homo sapiens
  Payload ID: 15052
  Gene Symbol:
  Gene Name: RP11-463C8.4
  ENSP ID: ENSP00000456507
MERKNPSRESPRRLSAKVGKGTEMKKVARQLGMAAAESDKDSGFSGILPGCLPHQTT

SEQ ID NO: 75835 - protein, 161 aa, Homo sapiens
  Payload ID: 15053
  Gene Symbol:
  Gene Name: RP11-463D19.2
  ENSP ID: ENSP00000454445
MASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHEAAYHKDFSLLFKD

SEQ ID NO: 75836 - protein, 815 aa, Homo sapiens
  Payload ID: 15054
  Gene Symbol:
  Gene Name: RP11-468E2.1
  ENSP ID: ENSP00000433967
MSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPGSTALRMTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 75837 - protein, 143 aa, Homo sapiens
  Payload ID: 15055
  Gene Symbol:
  Gene Name: RP11-468E2.2
  ENSP ID: ENSP00000454374
  MOD_RES (1)..(1): Any amino acid
XIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 75838 - protein, 98 aa, Homo sapiens; identical to SEQ ID NO: 40062
  Payload ID: 15055
  Gene Symbol:
  Gene Name: RP11-468E2.2
  ENSP ID: ENSP00000486380

SEQ ID NO: 75839 - protein, 547 aa, Homo sapiens
  Payload ID: 15056
  Gene Symbol:
  Gene Name: RP11-468E2.4
  ENSP ID: ENSP00000457512
SELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 75840 - protein, 283 aa, Homo sapiens
  Payload ID: 15057
  Gene Symbol:
  Gene Name: RP11-468E2.6
  ENSP ID: ENSP00000453089
  MOD_RES (1)..(1): Any amino acid
XWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSELEHGRSQGHRTNRKGHRLLSGHILPHTRGQDPADVADLHPGPLLPPAPLPHLPAANRALPCVCHTCHCLSLSRGGPISPSSAAQQSKQLVGRGGNMERGPVVGAGLGAGARIQALLGCLLKVLLWVASALLYFGSEQAARLLGSPCLRRLYHAWLAAVVIFGPLLQFHVNPRTIFASHGNFFN

SEQ ID NO: 75841 - protein, 331 aa, Homo sapiens
  Payload ID: 15058
  Gene Symbol:
  Gene Name: RP11-474G23.1
  ENSP ID: ENSP00000384974
MCSHFDADEIKRLGKRFKKLDLDNSGSLSVEEFMSLPELQQNPLVQRVIDIFDTDGNGEVDFKEFIEGVSQFSVKGDKEQKLRFAFRIYDMDKDGYISNGELFQVLKMMVGNNLKDTQLQQIVDKTIINADKDGDGRISFEEFCARGGKTGLFAGLASSVSMRPASPPSPAADSCSACRFFARRPPLRVTWVKPSSALALCVSISDSIPGNLKALPAETRAQLHHAEASLSQPPLQLRPFPKTSQAGDLQDLGPYVCVRKAVGKGDKQIRAVVKEHSVRSQERIWHYPGITTANMPGHLGQNTESGRDKLPMFGVWFPGCRFWGLWVWRLP

SEQ ID NO: 75842 - protein, 182 aa, Homo sapiens
  Payload ID: 15059
  Gene Symbol:
  Gene Name: RP11-475E11.9
  ENSP ID: ENSP00000349968
MTRPRKHAETLGGGKLCDLFCGRPGQVSSSRGRQGIPDMEPIVHIHQELLTGIESEASLSKLSPTSQKGTSSSSSYIFQKISQGKQMCQKLKEQTDQLKTKVQEFSKRIKQDSPYHLQDKKLVLEKLQGHLELLEQNFLATKDKHLTLQQQVHKHESTIVGDFDPERKVEGEIFKLEMLLED

SEQ ID NO: 75843 - protein, 145 aa, Homo sapiens
  Payload ID: 15060
  Gene Symbol:
  Gene Name: RP11-47I22.4
  ENSP ID: ENSP00000452401
  MOD_RES (1)..(1): Any amino acid
XDFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIWLLEE

SEQ ID NO: 75844 - protein, 68 aa, Homo sapiens
  Payload ID: 15061
  Gene Symbol:
  Gene Name: RP11-484M3.5
  ENSP ID: ENSP00000424708
METQNATTIPPYNPVDARFTSNFQAKDQALFPRLPSISSKLNYTSSQEKTQAIVTKSCCGIALTAECI

SEQ ID NO: 75845 - protein, 82 aa, Homo sapiens; identical to SEQ ID NO: 39556
  Payload ID: 15062
  Gene Symbol:
  Gene Name: RP11-49K24.6
  ENSP ID: ENSP00000465194

SEQ ID NO: 75846 - protein, 40 aa, Homo sapiens
  Payload ID: 15062
  Gene Symbol:
  Gene Name: RP11-49K24.6
  ENSP ID: ENSP00000473358
MAFTLYSLLQAALLCVNAIAVLHEERFLKNRNEGWQHAVH

SEQ ID NO: 75847 - protein, 40 aa, Homo sapiens; identical to SEQ ID NO: 75846
  Payload ID: 15062
  Gene Symbol:
  Gene Name: RP11-49K24.6
  ENSP ID: ENSP00000473502

SEQ ID NO: 75848 - protein, 546 aa, Homo sapiens
  Payload ID: 15063
  Gene Symbol:
  Gene Name: RP11-49K24.9
  ENSP ID: ENSP00000479069
MAAGSTTLRAVGKLQVRLATKTEPKKLEKYLQKLSALPMTADILAETGIRKTVKRLRKHQHVGDFARDLAARWKKLVLVDRNTGPDPQDPEESASRQRFGEALQEREKAWGFPENATAPRSPSHSPEHRRTARRTPPGQQRPHPRSPSREPRAERKRPRMAPADSGPHRDPPTRTAPLPMPEGPEPAVPGEQPGRGHAHAAQGGPLLGQGCQGQPQGEAVGSHSKGHKSSRGASAQKSPPVQESQSERLQAAGADSAGPKTVPSHVFSELWDPSEAWMQANYDLLSAFEAMTSQANPEALCAPALQEEAAFPGRRVNAKMPVYSGSRPACQLQVPTLRQQCLRVPRNNPDALGDVEGVPYSVLEPVLEGWTPDQLYRTEKDNAALARETDELWRIHCLQDFKEEKPQEHESWRELYLRLRDAREQRLRVVTTKIRSARENKPSGRQTKMICFNSVAKTPYDASRRQEKSAGAADPGNGEMEPAPKPAGSSQAPSGLGDGDGGSVSGGGSSNRHAAPADKTRKQAAKKVAPLMAKAIRDYKGRFSRR

SEQ ID NO: 75849 - protein, 177 aa, Homo sapiens
  Payload ID: 15064
  Gene Symbol:
  Gene Name: RP11-49P4.7
  ENSP ID: ENSP00000489149
MPPAEKSEGPPVPAPAERARGRVPGLPSPALCCACGLCALLAGVNVTLAGAFASFLPEHNALLVVGLALLVLALGFFAACCVCSRRGLAPRGRSAAAAGPGQGGGRAGPVALEMESSEPTAQDTTAVQLSPAVSAASSGCSSPGPSPLALEAPAPAAVCALRSEGVQLNPPRARAAP

SEQ ID NO: 75850 - protein, 51 aa, Homo sapiens
  Payload ID: 15065
  Gene Symbol:
  Gene Name: RP11-500M8.7
  ENSP ID: ENSP00000445121
  MOD_RES (1)..(1): Any amino acid
XSPEVILGHPYDVAIDMWSLGCITAELYTGYPLFPGENEVEQLACIMELTN

SEQ ID NO: 75851 - protein, 98 aa, Homo sapiens
  Payload ID: 15066
  Gene Symbol:
  Gene Name: RP11-505K9.4
  ENSP ID: ENSP00000476300
VGPYRRCYFFSHCSTPGEPLVVLHVALTGDISSNIQAIVKEHPPSETEEKNKITAAIFYSISLTQQGLQGVELGTFLIKRVVKELQMESRSVAQAEVQ

SEQ ID NO: 75852 - protein, 91 aa, Homo sapiens
  Payload ID: 15066
  Gene Symbol:
  Gene Name: RP11-505K9.4
  ENSP ID: ENSP00000477143
VGPYRRCYFFSHCSTPGEPLVVLHVALTGDISSNIQAIVKEHPPSETEEKNKITAAIFYSISLTQQGLQGVELGTFLIKRVVKELQYRPLS

SEQ ID NO: 75853 - protein, 175 aa, Homo sapiens
  Payload ID: 15066
  Gene Symbol:
  Gene Name: RP11-505K9.4
  ENSP ID: ENSP00000484042
  MOD_RES (1)..(1): Any amino acid
XAVHPVKNWMDMKRRVGPYRRCYFFSHCSTPGEPLVVLHVALTGDISSNIQAIVKEHPPSETEEKNKITAAIFYSISLTQQGLQGVELGTFLIKRVVKELQFTHSKPLGSHRPGTVGWGSGDREAAAGEICSADKRFLLLSPHQSCFLPGTSPSPSPSPCWQMLRYPGLWLPGCA

SEQ ID NO: 75854 - protein, 70 aa, Homo sapiens
  Payload ID: 15067
  Gene Symbol:
  Gene Name: RP11-506B6.7
  ENSP ID: ENSP00000486440
MAKRLQAELSCPVCLDFFSCSISLSCTHVFCFDCIQRYILENHDFRAMCPLCRDVVKVPALEEWQVSVLT

SEQ ID NO: 75855 - protein, 35 aa, Homo sapiens
  Payload ID: 15067
  Gene Symbol:
  Gene Name: RP11-506B6.7
  ENSP ID: ENSP00000486934
MAKRLQAELSCPVCLDFFSCSISLSCTHVFCFDCI

SEQ ID NO: 75856 - protein, 128 aa, Homo sapiens
  Payload ID: 15067
  Gene Symbol:
  Gene Name: RP11-506B6.7
  ENSP ID: ENSP00000487146
MAKRLQAELSCPVCLDFFSCSISLSCTHVFCFDCIQRYILENHDFRAMCPLCRDVVKVPALEEWQVSVLTLMTKQHNSRLEQSLHVREELRHFREDVTLDAATASSLLVFSNDLRSAQCKKIHHDLTK

SEQ ID NO: 75857 - protein, 212 aa, Homo sapiens
  Payload ID: 15068
  Gene Symbol:
  Gene Name: RP11-507M3.1
  ENSP ID: ENSP00000483650
MEVLAKEDTEAAIQSILYKENSVIKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRNKGSSFLEREPLCYQEGNNPSAKEAISEGYFSSLSLSQEREEDQDGSCSVSQLEWIQAWLASASTSRTQVILPPQLPE

SEQ ID NO: 75858 - protein, 203 aa, Homo sapiens
  Payload ID: 15069
  Gene Symbol:
  Gene Name: RP11-511P7.5
  ENSP ID: ENSP00000489013
MTELASSGGGSPAGDGEEGLGDERGLVIHHPAEEQPYRCPLCGQTFSQQPSLVRHQKAHAGAGRAAAFVCPECGKAFSVKHNLEVHQRTHTGERPFPCPECGRCFSLKQNLLTHQRIHSGEKPHQCAQCGRCFREPRFLLNHQRTHARMPAPHPRRPGVFGERRPYFCPRCGKSFAREGSLKTHQRSHGHGPEGQAAHLGRVL

SEQ ID NO: 75859 - protein, 94 aa, Homo sapiens
  Payload ID: 15069
  Gene Symbol:
  Gene Name: RP11-511P7.5
  ENSP ID: ENSP00000489247
MTELASSGGGSPAGDGEEGLGDERGLVIHHPAEEQPYRCPLCGQTFSQQPSLVRHQKAHAGAGRAAAFVCPECGKAFSVKHNLELQSGQDLKTR

SEQ ID NO: 75860 - protein, 203 aa, Homo sapiens; identical to SEQ ID NO: 75858
  Payload ID: 15069
  Gene Symbol:
  Gene Name: RP11-511P7.5
  ENSP ID: ENSP00000489517

SEQ ID NO: 75861 - protein, 538 aa, Homo sapiens
  Payload ID: 15070
  Gene Symbol:
  Gene Name: RP11-512M8.5
  ENSP ID: ENSP00000454454
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKQVANMMIRMKREFTGSQNSIFPVFDNLLLLDRNVDLLTPLATQLTYEGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARGSLANHTSIAELIKDVTTSEDFFDKLTVEQEFMSGIDTDKVNNYIEDCIAQKHSLIKVLRLVCLQSVCNSGLKQKVLDYYKREILQTYGYEHILTLHNLEKAGLLKPQTGGRNNYPTIRKTLRLWMDDVNEQNPTDISYVYSGYAPLSVRLAQLLSRPGWRSIEEVLRILPGPHFEERQPLPTGLQKKRQPGENRVTLIFFLGGVTFAEIAALRFLSQLEDGEIRASFP

SEQ ID NO: 75862 - protein, 185 aa, Homo sapiens
  Payload ID: 15071
  Gene Symbol:
  Gene Name: RP11-514O12.4
  ENSP ID: ENSP00000426906
  MOD_RES (1)..(1): Any amino acid
XLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQTTEEDLNLDVEPTTEDTAEEVTIHVLLHSALFGEIGPRRW

SEQ ID NO: 75863 - protein, 296 aa, Homo sapiens
  Payload ID: 15072
  Gene Symbol:
  Gene Name: RP11-514P8.6
  ENSP ID: ENSP00000429397
MDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCPSSSPSSPAQVPPLPGSPLGPSPVSVGAVCPWLLPESIAEIWTQDSGLPALGWQHWQQRPLLHREGGQ

SEQ ID NO: 75864 - protein, 276 aa, Homo sapiens
  Payload ID: 15073
  Gene Symbol:
  Gene Name: RP11-514P8.7
  ENSP ID: ENSP00000423309
MSSSFKKLYFSLTTEALSFAKTPSSKCVNELNQWLSALRKVSINNTGLLGSYHPGVFRGDKWSCCHQKEKTGQGCDKTRSRVTLQEWNDPLDHDLEAQLIYRHLLGVEAMLWITINKDTKVPNACLFTINKEDHTLGNIIKSRACFPFAFCRDCQFPEASPATLPVQPAELLAWKSPCATGKDINKHQEVSKSTRSHRHHVDIHLPVFPGKILLNCAALAKRAAPEHISYVPQLSNDTLAGRLTLSTFTLEQPLGQFSSHNISDLDTIWLVVALSN

SEQ ID NO: 75865 - protein, 54 aa, Homo sapiens
  Payload ID: 15074
  Gene Symbol:
  Gene Name: RP11-51F16.8
  ENSP ID: ENSP00000464100
  MOD_RES (1)..(1): Any amino acid
XADKNRARVEENFLKLTHVQRQEAAQSRREEKKRAEKERIMNEEDPEKQRRLEV

SEQ ID NO: 75866 - protein, 69 aa, Homo sapiens
  Payload ID: 15075
  Gene Symbol:
  Gene Name: RP11-51L5.7
  ENSP ID: ENSP00000473468
MFILTTNGDLPRPIFIPNGMPNTVVPCGTEKNFTNGMVNGHMPSLPDSPFTGYIIAVHRKMDGRGRGRG

SEQ ID NO: 75867 - protein, 138 aa, Homo sapiens
  Payload ID: 15076
  Gene Symbol:
  Gene Name: RP11-520P18.5
  ENSP ID: ENSP00000455811
MERLVLTLCTLPLAVASAGCATTPARNLSCYQCFKVSSWTECPPTWCSPLDQVCISNEVVVSFKWSVRVLLSKRCAPRCPNDNMKFEWSPAPMVQGVITRRCCSWALCNRALTPQEGRWALRGGLLLQVGLSLLRALL

SEQ ID NO: 75868 - protein, 138 aa, Homo sapiens; identical to SEQ ID NO: 75867
  Payload ID: 15076
  Gene Symbol:
  Gene Name: RP11-520P18.5
  ENSP ID: ENSP00000487842

SEQ ID NO: 75869 - protein, 479 aa, Homo sapiens
  Payload ID: 15077
  Gene Symbol:
  Gene Name: RP11-529K1.3
  ENSP ID: ENSP00000399208
MATDSWALAVDEQEAAAESLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 75870 - protein, 261 aa, Homo sapiens
  Payload ID: 15077
  Gene Symbol:
  Gene Name: RP11-529K1.3
  ENSP ID: ENSP00000454699
MATDSWALAVDEQEAAAESLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQ

SEQ ID NO: 75871 - protein, 30 aa, Homo sapiens; identical to SEQ ID NO: 22815
  Payload ID: 15077
  Gene Symbol:
  Gene Name: RP11-529K1.3
  ENSP ID: ENSP00000455483

SEQ ID NO: 75872 - protein, 233 aa, Homo sapiens
  Payload ID: 15078
  Gene Symbol:
  Gene Name: RP11-540D14.8
  ENSP ID: ENSP00000426741
MRLLPLLRTVLWAAFLGSPLRGGSSLRHVVYWNSSNPSLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 75873 - protein, 331 aa, Homo sapiens
  Payload ID: 15079
  Gene Symbol:
  Gene Name: RP11-542C16.2
  ENSP ID: ENSP00000468744
  MOD_RES (1)..(1): Any amino acid
XGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAPPREEQPPPVLLSPSLQYAGAETLASKVQFRDPKSQRTHQAQVAFQEPINTVSEPPPRPLSRAPLSGARVPWGATRWAREIKES

SEQ ID NO: 75874 - protein, 405 aa, Homo sapiens
  Payload ID: 15079
  Gene Symbol:
  Gene Name: RP11-542C16.2
  ENSP ID: ENSP00000468772
  MOD_RES (1)..(1): Any amino acid
XSLVLGVITCAPERLNFPASACALKRAAWLLRGRGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAPPREEQPPPVLLSPSLQYAGAETLASKVQFRDPKSQRTHQAQVAFQRSLSLCPHEAAFSGATGREWGRVGARKMGASVQLLLTLISKEPINTVSEPPPRPLSRAPLSGARVPWGATRWAREIKES

SEQ ID NO: 75875 - protein, 61 aa, Homo sapiens
  Payload ID: 15080
  Gene Symbol:
  Gene Name: RP11-544M22.13
  ENSP ID: ENSP00000289779
MAGDGVSLLMPSRLECNGAISAHCNLLLPEVLLSPLAPTENPASQEVATSGTPTNQGAVTC

SEQ ID NO: 75876 - protein, 35 aa, Homo sapiens
  Payload ID: 15080
  Gene Symbol:
  Gene Name: RP11-544M22.13
  ENSP ID: ENSP00000473373
MAGEVLLSPLAPTENPASQEVATSGTPTNQGAVTC

SEQ ID NO: 75877 - protein, 687 aa, Homo sapiens
  Payload ID: 15081
  Gene Symbol:
  Gene Name: RP11-545J16.1
  ENSP ID: ENSP00000370952
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETNIDPSENSTSNLPNCLINQMLSLNRTPSEIIERGCVKESGSHMWIYVFMGNMLRGIGETPIVPLGISYIDDFAKEGHSSLYLGTVNVMGMTGLVFAFMLGSLFAKMYVDIGYVDLSTIRITPKDSRWVGAWWLGFLVSGIVSIISSIPFFFLPLNPNKPQKERKVSLFLHVLKTNDKRNQIANLTNRRKYITKNVTGFFQSLKSILTNPLYVIFVIFTLLHMSSYIASLTYIIKMVEQQYGWSASKTNFLLGVLALPAVAIGMFSGGYIIKKFKLSLVGLAKLAFCSATVHLLSQVLYFFLICESKSVAGLTLTYDGNSPVRSHVDVPLSYCNSECNCDESQWEPVCGNNGITYLSPCLAGCKSSSGNKEPIVFYNCSCVEVIGLQNKNYSAHLGECPRDDACTRKSYVYFVIQVLDAFLCAVGLTSYSVLVIRIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 75878 - protein, 748 aa, Homo sapiens
  Payload ID: 15081
  Gene Symbol:
  Gene Name: RP11-545J16.1
  ENSP ID: ENSP00000441269
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 75879 - protein, 91 aa, Homo sapiens
  Payload ID: 15082
  Gene Symbol:
  Gene Name: RP11-546B8.6
  ENSP ID: ENSP00000477989
MTPTRVGRIRPRPGFGRGLAATLETLPGSGQADRGVTRRCPRVPAAAGLGTRGRPVGSGDLTLVIRCRMEGGCGRAWEPARGSAGLGTSGS

SEQ ID NO: 75880 - protein, 449 aa, Homo sapiens
  Payload ID: 15083
  Gene Symbol:
  Gene Name: RP11-548K23.11
  ENSP ID: ENSP00000359683
MLGPQVWSSVRQGLSRSLSRNVGVWASGEGKKVDIAGIYPPVTTPFTATAEVDYGKLEENLHKLGTFPFRGAVGGVCALANVLGAQVCQLERLCCTGQWEDAQKLQHRLIEPNAARIIAVFKPKNEEPYGHLNPKWTKWLQKLCCPCCFGRDCLVLNQGYLSEAGASLVDQKLELNIVPRTKVVYLASETFNYSAIDRVKSRGKRLALEKVPKVGQRFNRIGLPPKVGSFQLFVEGYKDADYWLRRFEAEPLPENTNRQLLLQFERLVVLDYIIRNTDRGNDNWLIKYDCPMDSSSSRDTDWVVVKEPVIKVAAIDNGLAFPLKHPDSWRAYPFYWAWLPQAKVPFSQEIKDLILPKISDPNFVKDLEEDLYELFKKDPGFDRGQFHKQIAVMRGQILNLTQALKDNKSPLHLVQMPPVIVETARSHQRSSSESYTQSFQSRKPFFSWW

SEQ ID NO: 75881 - protein, 75 aa, Homo sapiens
  Payload ID: 15084
  Gene Symbol:
  Gene Name: RP11-552F3.12
  ENSP ID: ENSP00000464919
KMFPVICWTSPKEQADVLIKRSAYKIGQDQAPLATCLSPPAPAVCGGTWQLDHSQEKGTISPASNMQKLRPGEIK

SEQ ID NO: 75882 - protein, 123 aa, Homo sapiens
  Payload ID: 15084
  Gene Symbol:
  Gene Name: RP11-552F3.12
  ENSP ID: ENSP00000467180
QGPAASSQSALMPPAPTTRWCSQPPTGLDPSPLHLHARLALLRHMAEQKMFPVICWTSPKEQADVLIKRSAYKIGQDQAPLATCLSPPAPAVCGGTWQLDHSQEKGTISPASNMQKLRPGEIK

SEQ ID NO: 75883 - protein, 583 aa, Homo sapiens; identical to SEQ ID NO: 43356
  Payload ID: 15085
  Gene Symbol:
  Gene Name: RP11-561B11.2
  ENSP ID: ENSP00000454657

SEQ ID NO: 75884 - protein, 51 aa, Homo sapiens
  Payload ID: 15086
  Gene Symbol:
  Gene Name: RP11-565P22.6
  ENSP ID: ENSP00000356909
KFRESGIASEYESNTDESEERDSWSQEELPRLLNVLQRQELGDGLDDEIAV

SEQ ID NO: 75885 - protein, 150 aa, Homo sapiens
  Payload ID: 15086
  Gene Symbol:
  Gene Name: RP11-565P22.6
  ENSP ID: ENSP00000405676
MLQHISLLVKQVQELELKLSGQNAMGSQDSLLEITFRSGALPVLCDPTTPKPEDLHSPPLGAGLADFAHPAGSPLVDHGMFENLNTALTPKLQASRSFPHLSKPVAPGSAPLGSGEPGGPGLWVGSSQHLKNLGKAMGAKVNDFLRRKEP

SEQ ID NO: 75886 - protein, 797 aa, Homo sapiens
  Payload ID: 15087
  Gene Symbol:
  Gene Name: RP11-566K11.2
  ENSP ID: ENSP00000451560
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSCSQDRALVSWDVKSLGGSVCQELLPQQPQEKGLCDQKASSTALQRLLQKEFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 75887 - protein, 161 aa, Homo sapiens
  Payload ID: 15088
  Gene Symbol:
  Gene Name: RP11-571M6.15
  ENSP ID: ENSP00000449309
  MOD_RES (1)..(1): Any amino acid
XCNYFESQNVDFRGKKVIELGAGTGIVGILAALQGWVSSASVAPAKAHILCWAPSVCLGLQQGAPHEAAAENRLLLCKLQESSGDLWRGPQTDGVLLCGPGRRAMSCVVFACTVMRLLIGRYILRNGVVRRFWLMHIIEYLHKPRWYIVLQPGLYGIASCS

SEQ ID NO: 75888 - protein, 124 aa, Homo sapiens
  Payload ID: 15088
  Gene Symbol:
  Gene Name: RP11-571M6.15
  ENSP ID: ENSP00000449544
VDFRGKKVIELGAGTGIVGILAALQGWVSSASVAPAKAHILCWAPSVCLGLQQGAPHEAAAENRLLLCKLQESSGDLWRGPQTDGVLLCGPGRRAMAEIWLHKEAQKEGWSKAAKLQGRKTKEG

SEQ ID NO: 75889 - protein, 304 aa, Homo sapiens
  Payload ID: 15089
  Gene Symbol:
  Gene Name: RP11-574F21.3
  ENSP ID: ENSP00000450870
ETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMLTWLFFCGSQWVYGPWLTYVETGFTMLAWFQTSFELLTSSDPPTSASQSARITGMSHRARPDLTFLKSTLAALCLTVMAIMEVDKRGSLSSSPEEMSGAEEGRETSSGIEVEASDLSLSLTGDDGGPNRTSTESRGTDTESSGEDKDSDSMEDTGHYSINDE

SEQ ID NO: 75890 - protein, 751 aa, Homo sapiens
  Payload ID: 15089
  Gene Symbol:
  Gene Name: RP11-574F21.3
  ENSP ID: ENSP00000451235
MSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMLTWLFFCGSQWVYGPWLTYVGWLQQTSFKMSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 75891 - protein, 815 aa, Homo sapiens
  Payload ID: 15090
  Gene Symbol:
  Gene Name: RP11-574K11.31
  ENSP ID: ENSP00000475031
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGLMMIRDFGARDLKVVRLAV

SEQ ID NO: 75892 - protein, 43 aa, Homo sapiens
  Payload ID: 15090
  Gene Symbol:
  Gene Name: RP11-574K11.31
  ENSP ID: ENSP00000476336
  MOD_RES (1)..(1): Any amino acid
XIVDGQELRTNPAASMESIQKFLGLMMIRDFGARDLKVVRLAV

SEQ ID NO: 75893 - protein, 53 aa, Homo sapiens
  Payload ID: 15091
  Gene Symbol:
  Gene Name: RP11-58C22.1
  ENSP ID: ENSP00000455258
VTGHVTESSCMAQPGTDATSRERTHSFADHSGTIDDREPLANAIKSDSAVIGG

SEQ ID NO: 75894 - protein, 32 aa, Homo sapiens
  Payload ID: 15092
  Gene Symbol:
  Gene Name: RP11-598P20.5
  ENSP ID: ENSP00000435061
  MOD_RES (1)..(1): Any amino acid
XWRGRGKRPAAEDHTQATCSRPQQGTEQNGLI

SEQ ID NO: 75895 - protein, 121 aa, Homo sapiens
  Payload ID: 15093
  Gene Symbol:
  Gene Name: RP11-599B13.6
  ENSP ID: ENSP00000464383
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIGTGCDRTSQP

SEQ ID NO: 75896 - protein, 145 aa, Homo sapiens
  Payload ID: 15094
  Gene Symbol:
  Gene Name: RP11-5A19.5
  ENSP ID: ENSP00000464271
  MOD_RES (1)..(1): Any amino acid
XDARASPLPNEAWVALRRRHPGLAVELELEPALPAESVTRVLQPAVPVAALRLNLSGDTVGPVRFAAHHYAATLCALEVRAAASAELNAALEELAARCAALREVHCFCVVSHSVLDAFRAHCPRLRTYTLKLTREPHPWRPTLVA

SEQ ID NO: 75897 - protein, 37 aa, Homo sapiens
  Payload ID: 15094
  Gene Symbol:
  Gene Name: RP11-5A19.5
  ENSP ID: ENSP00000476527
  MOD_RES (1)..(1): Any amino acid
XVSHSVLDAFRAHCPRLRTYTLKLTREPHPWRPTLVA

SEQ ID NO: 75898 - protein, 45 aa, Homo sapiens
  Payload ID: 15094
  Gene Symbol:
  Gene Name: RP11-5A19.5
  ENSP ID: ENSP00000476658
  MOD_RES (1)..(1): Any amino acid
XREVHCFCVVSHSVLDAFRAHCPRLRTYTLKLTREPHPWRPTLVA

SEQ ID NO: 75899 - protein, 160 aa, Homo sapiens
  Payload ID: 15095
  Gene Symbol:
  Gene Name: RP11-603J24.9
  ENSP ID: ENSP00000449770
MPDTHLKGVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPI

SEQ ID NO: 75900 - protein, 64 aa, Homo sapiens
  Payload ID: 15096
  Gene Symbol:
  Gene Name: RP11-613M10.8
  ENSP ID: ENSP00000457849
EDVISSIRNFLIYVALLRVSECLPGCDCETSGELTDGHPLTLRGHRGLRTELNAPFILKKLDSI

SEQ ID NO: 75901 - protein, 297 aa, Homo sapiens
  Payload ID: 15097
  Gene Symbol:
  Gene Name: RP11-613M10.9
  ENSP ID: ENSP00000457548
MAKWLNKYFSLGNSKTKSPPQPPRPDYREQRRRGERPSQPPQAVPQASSAASASCGPATASCFSASSGSLPDDSGSTSDLIRAYRAQKERDFEDPYNGPGSSLRKLRAMCRLDYCGGSGEPGGVQRAFSASSASGAAGCCCASSGAGAAASSSSSSGSPHLYRSSSERRPATPAEVRYISPKHRLIKVESAAGGGAGDPLGGACAGGRTWSPTACGGKKLLNKCAASAAEESGAGKKDKVTIADDYSDPFDAKNDLKSKAGKGESAGYMEPYEAQRIMTGLQEAWRHSPSGCFPVGP

SEQ ID NO: 75902 - protein, 209 aa, Homo sapiens
  Payload ID: 15098
  Gene Symbol:
  Gene Name: RP11-618P17.4
  ENSP ID: ENSP00000468690
  MOD_RES (1)..(1): Any amino acid
XNGKYITKSGTRVDHQTGPIVWGEPGTNGQHAFYQLIHQGTKMIPCDFLIPVQTQHPIRKGLHHKDALPTVAAPRPVCQRCGQPLALVVQVYCPLEGSPFHRLLHVFACACPGCSTGGARSWKVFRSQCLQVPEREAQDAQKQGNSLAAEDWCEGADDWGSDTEEGPSPQFTLDFGNDASSAKDVDWTARLQDLRLQDAVLGAAHPVPP

SEQ ID NO: 75903 - protein, 132 aa, Homo sapiens
  Payload ID: 15098
  Gene Symbol:
  Gene Name: RP11-618P17.4
  ENSP ID: ENSP00000475682
MVLKTALRLCLFRVNSWTRPRMTAISWQDAQDALPTVAAPRPVCQRCGQPLALVVQVYCPLEGSPFHRLLHVFACACPGCSTGGARSWKVFRSQCLQVPEREAQDAQKQGNSLAAEDWCEGADDWGSDTEEG

SEQ ID NO: 75904 - protein, 88 aa, Homo sapiens
  Payload ID: 15099
  Gene Symbol:
  Gene Name: RP11-619A10.1
  ENSP ID: ENSP00000478090
MGNIFEKLFKSLLGKKKMRILILSLDTAGKTTILYKLKLGETVPAVPTVGFCVETVEYKNNTFGVWDVGSHFKIRPLWQHFFQNTKGS

SEQ ID NO: 75905 - protein, 177 aa, Homo sapiens
  Payload ID: 15099
  Gene Symbol:
  Gene Name: RP11-619A10.1
  ENSP ID: ENSP00000479272
MGNIFEKLFKSLLGKKKMRILILSLDTAGKTTILYKLKLGETVPAVPTVGFCVETVEYKNNTFGVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVVK

SEQ ID NO: 75906 - protein, 87 aa, Homo sapiens
  Payload ID: 15099
  Gene Symbol:
  Gene Name: RP11-619A10.1
  ENSP ID: ENSP00000480600
MGNIFEKLFKSLLGKKKMRILILSLDTAGKTTILYKLKLGETVPAVPTVGFCVETVEYKNNTFGVWDVGSHFKIRPLWQHFFQNTKA

SEQ ID NO: 75907 - protein, 125 aa, Homo sapiens
  Payload ID: 15099
  Gene Symbol:
  Gene Name: RP11-619A10.1
  ENSP ID: ENSP00000482014
MGNIFEKLFKSLLGKKKMRILILSLDTAGKTTILYKLKLGETVPAVPTVGFCVETVEYKNNTFGVWDVGSHFKIRPLWQHFFQNTKELSASQFAQFIKKLCGVTGTNDEASPGSLTSYPSHLLDR

SEQ ID NO: 75908 - protein, 95 aa, Homo sapiens
  Payload ID: 15099
  Gene Symbol:
  Gene Name: RP11-619A10.1
  ENSP ID: ENSP00000486600
MGNIFEKLFKSLLGKKKMRILILSLDTAGKTTILYKLKLGETVPAVPTVGFCVETVEYKNNTFGVWDVGSHFKIRPLWQHFFQNTKAAHSQSLTS

SEQ ID NO: 75909 - protein, 42 aa, Homo sapiens
  Payload ID: 15100
  Gene Symbol:
  Gene Name: RP11-637O19.3
  ENSP ID: ENSP00000417929
MEKPLFPLVPLHWFGFGYTALVVSGGIVGYVKTEKQRCFAAY

SEQ ID NO: 75910 - protein, 114 aa, Homo sapiens
  Payload ID: 15101
  Gene Symbol:
  Gene Name: RP11-644F5.10
  ENSP ID: ENSP00000257899
  MOD_RES (1)..(1): Any amino acid
XSSFRSRRGPGVPSPQPDVTMLSRLLKEHQAKQNERKELQEKRRREAITAATCLTEALVDHLNVGVAQAYMNQRKLDHEVKTLQVQAAQFAKQTGQWIGMVENFNQALKGFLVW

SEQ ID NO: 75911 - protein, 44 aa, Homo sapiens
  Payload ID: 15101
  Gene Symbol:
  Gene Name: RP11-644F5.10
  ENSP ID: ENSP00000447621
MNQRKLDHEVKTLQVQAAQFAKQTGQWIGMVENFNQALKGFLVW

SEQ ID NO: 75912 - protein, 122 aa, Homo sapiens
  Payload ID: 15101
  Gene Symbol:
  Gene Name: RP11-644F5.10
  ENSP ID: ENSP00000447650
MAPGSRGERSSFRSRRGPGVPSPQPDVTMLSRLLKEHQAKQNERKELQEKRRREAITAATCLTEALVDHLNVGVAQAYMNQRKLDHEVKTLQVQAAQFAKQTGQWIGMVENFNQALKGFLVW

SEQ ID NO: 75913 - protein, 54 aa, Homo sapiens
  Payload ID: 15101
  Gene Symbol:
  Gene Name: RP11-644F5.10
  ENSP ID: ENSP00000450201
MAPGSRGERSSFRSRRGPGVPSPQPDVTMLSRLLKEHQAKQNERKELQVWPRPT

SEQ ID NO: 75914 - protein, 157 aa, Homo sapiens
  Payload ID: 15102
  Gene Symbol:
  Gene Name: RP11-65B7.2
  ENSP ID: ENSP00000486083
  MOD_RES (1)..(1): Any amino acid
XGRKEPDSYDGITTNQRGVTIAALGADCIPIVFADPVKKACGVAHAGWKGTLLGVAMATVNAMIAEYGCSLEDIVVVLGPSVGPCCFTLPRESAEAFHNLHPACVQLFDSPNPCIDIRKATRYIFPGTFSCQHPYFFSYCFGYWENKLLLSFEKYFS

SEQ ID NO: 75915 - protein, 18 aa, Homo sapiens
  Payload ID: 15103
  Gene Symbol:
  Gene Name: RP11-691N7.6
  ENSP ID: ENSP00000457993
  MOD_RES (1)..(1): Any amino acid
XKFPEPQEVVEELKKYLS

SEQ ID NO: 75916 - protein, 104 aa, Homo sapiens
  Payload ID: 15104
  Gene Symbol:
  Gene Name: RP11-697E2.12
  ENSP ID: ENSP00000479373
  MOD_RES (1)..(1): Any amino acid
XFQKIRRQMEAPGAPPRTLTWEAMEQIRWHFSTPLEPVPRRSKGCAASPWLTQWPRPRRSQKQQPQPQGLGESTSPHMGARGQCQRCGTGRRRRSSGWPRTGRR

SEQ ID NO: 75917 - protein, 217 aa, Homo sapiens
  Payload ID: 15105
  Gene Symbol:
  Gene Name: RP11-697E2.6
  ENSP ID: ENSP00000456615
MEPSTCRTMESEEDYVEEKESEKCVKEGVTNPSNSSQQALLKADYKALKNGVPSPIMATKIPKKVIAPVDTGDLEAGRRKRRRKRRSLAINLTNCKYESVRRAAQMCGLKEVGEDEEWTLYWTDCAVSLERVMDMKRFQPLLIDGFKFDMRVYVLITSCDPLRIFTYEEGLARFATTPYMEPSHNNLDNVCMHLTNYAINKHNENFVRDGAVGSKSI

SEQ ID NO: 75918 - protein, 385 aa, Homo sapiens
  Payload ID: 15106
  Gene Symbol:
  Gene Name: RP11-717K11.2
  ENSP ID: ENSP00000423373
MNAFLDDPEFADIMLRAEQAIEVGIFPERISQGSSGSYFVKDPKRKIIGVFKPKSEEPYGQLNPKWTKYVHKVCCPCCFGRGCLIPNQGYLSEAGAYLVDNKLHLSIVPKTKVVWLVSETFNYNAIDRAKSRGKKYALEKVPKVGRKFHRIGLPPKIGSFQLFVEGYKEAEYWLRKFEADPLPENIRKQFQSQFERLVILDYIIRNTDRGNDNWLVRYEKQKCEKEIDHKESKWIDDEEFLIKIAAIDNGLAFPFKHPDEWRAYPFHWAWLPQAKVPFSEEIRNLILPYISDMNFVQDLCEDLYELFKTDKGFDKATFESQMSVMRGQILNLTQALRDGKSPFQLVQIPCVIVERSQGGSQGRIVHLSNSFTQTVNCRKPFFSSW

SEQ ID NO: 75919 - protein, 45 aa, Homo sapiens
  Payload ID: 15107
  Gene Symbol:
  Gene Name: RP11-722G7.1
  ENSP ID: ENSP00000472749
MSDKPDLSEVEKFDRSKLKKTNTEEKNTLPSKETIQQEKECVQTS

SEQ ID NO: 75920 - protein, 80 aa, Homo sapiens
  Payload ID: 15107
  Gene Symbol:
  Gene Name: RP11-722G7.1
  ENSP ID: ENSP00000484052
MSDKPDLSEVEKFDRSKLKKTNTEEKNTLPSKEKGVSLCRQAGVQRHDFGSLQTSLPEFKQFSCLSLPSSWDLRHITKPG

SEQ ID NO: 75921 - protein, 544 aa, Homo sapiens
  Payload ID: 15108
  Gene Symbol:
  Gene Name: RP11-724O16.1
  ENSP ID: ENSP00000424363
MSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQIRSIKIRDSKFGLALVIESSQQSGGYVLGFKIDPVEKLQESVKEINSLHKVYSASPIFGVDYEMEEKPQPLEALTVEQIQDDVEIDSDGHTDAFVAYFADGNKLDSIASEWVGLPPLPSARCLFGLGEVDDKIYVVAGKDLQTEASLDSVLCYDPVAAKWNEVKKLPIKVYGHNVISHKGMIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKYEDDKKEWAGMLKEIRYASGASCLATRLNLFKLSKL

SEQ ID NO: 75922 - protein, 86 aa, Homo sapiens
  Payload ID: 15109
  Gene Symbol:
  Gene Name: RP11-729L2.2
  ENSP ID: ENSP00000465737
MSMDVTFLGTGAAYPSPTRGASAVVLRCEGECWLFDCGEGTQTQLMKSQLKAGYPEYMSNNFPCNVSCCFSLFPKDQNCFRNWRHI

SEQ ID NO: 75923 - protein, 108 aa, Homo sapiens
  Payload ID: 15110
  Gene Symbol:
  Gene Name: RP11-736N17.11
  ENSP ID: ENSP00000489570
MSTPRPAPPQPGAAEGAGGPEGKAVAGAWEKGPRLGQRLPSIVVEPSEADPVESGELRWPLESAQRGPSQSRAAAAPSPSLPGEPGKAADNAGSECACSEDPAAPARG

SEQ ID NO: 75924 - protein, 732 aa, Homo sapiens
  Payload ID: 15111
  Gene Symbol:
  Gene Name: RP11-73M18.2
  ENSP ID: ENSP00000439065
MLPCAAGARGRGAMVVLRAGKKTFLPPLCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGQKATLNAEEMADFYKEFLSKNFQKHMYYNRMYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGMRKMKLGLVN

SEQ ID NO: 75925 - protein, 168 aa, Homo sapiens
  Payload ID: 15112
  Gene Symbol:
  Gene Name: RP11-745O10.4
  ENSP ID: ENSP00000454670
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGRCRSPSFLWIHHL

SEQ ID NO: 75926 - protein, 43 aa, Homo sapiens
  Payload ID: 15113
  Gene Symbol:
  Gene Name: RP11-761B3.1
  ENSP ID: ENSP00000476793
  MOD_RES (1)..(1): Any amino acid
XSEWRERAEWLCGRVSETGSACSMADQLTEEQIAETSPKDFLF

SEQ ID NO: 75927 - protein, 523 aa, Homo sapiens
  Payload ID: 15114
  Gene Symbol:
  Gene Name: RP11-762I7.5
  ENSP ID: ENSP00000447000
  MOD_RES (1)..(1): Any amino acid
XPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 75928 - protein, 111 aa, Homo sapiens
  Payload ID: 15114
  Gene Symbol:
  Gene Name: RP11-762I7.5
  ENSP ID: ENSP00000447077
EGDFWAESSMLGLKITYFALMDGKVYDITEWAGCQRVGISPDTHRVPYHISFGSRIPGTRGRQRATPDAPPADLQDFLSRIFQSLQLLPASSDPRPAMGAAPATTPEVSRK

SEQ ID NO: 75929 - protein, 172 aa, Homo sapiens
  Payload ID: 15114
  Gene Symbol:
  Gene Name: RP11-762I7.5
  ENSP ID: ENSP00000447649
  MOD_RES (1)..(1): Any amino acid
XLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKSSVSVPSPCPWSCPKTHPSVFVDAKDTNPMELGQLRQQYT

SEQ ID NO: 75930 - protein, 121 aa, Homo sapiens
  Payload ID: 15114
  Gene Symbol:
  Gene Name: RP11-762I7.5
  ENSP ID: ENSP00000449809
AECNRLHPAEEGDFWAESSMLGLKITYFALMDGKVYDITEWAGCQRVGISPDTHRVPYHISFGSRIPGTRGRQRATPDAPPADLQDFLSRIFQSLQLLPASSDPRPAMGAAPATTPEVSRK

SEQ ID NO: 75931 - protein, 1793 aa, Homo sapiens
  Payload ID: 15115
  Gene Symbol:
  Gene Name: RP11-766F14.2
  ENSP ID: ENSP00000427555
MLSFHFWKSRGQPTDAASSVADGIQTPRCCRRCQANNWTGQLSYRTLATVSAGAAAPQPQTTSTASSRSLPTSLRLAAAPPQGLKNWEVVAAVAAVPTALGPVQIRGTLLRATLQPLRGQRRTQDFPSDHHCLFLSLKPGQGLIMEAAPPELNSKARQAEVGDGVSSAQDSQELKQQLWPLPKPSASSQREAKYVDMCASAEVQRESPQTMKLTLGHCPGGQRASRSPKEKAQDEPSSKTPSPQNNPASSQLSRSQHSASEEGGNFSSSSSSSPMNKAEEDGLSKMEDSTTSTGALATSSSSLGFESESGESEGCQAVGGEGEKISGGGGGGKGGGGGGAGDGTECRDIIAKSQGSRDPPKVEEAHYITTHEIQLSEVEQDMDFDVGLASRWDFEDNNVIYSFVDYASFGGSDETPGDITSLTEEDDDNSCYLSTTPSTNTTRTPSPTSSDLARPNAGRSGRDTSSTEVGSGPSDSGPTPPPTGPGTAPLTEPLPETPEAASGAAAAAASSCGSAASQILLSIKPASRAINEPSNVRAKQNIIYAAKHEGDMSLRVSTAAEHNSSSLKQNPAAAVAQDHAKKFIAVPARLQTRCGAIRAKELVDYSSGASSAVSELDDADKEVRNLTSRAFRSLAYPYFEALNISSRESSTTLSEVGFGRWSTFLDLKCGGVGARVEQSLLRSSAASVAAGLRKGSGARATADQLYIQSKKSQTKALEFVVSKVEGEIKHVETPLCFQKQVQTGSRVVTLLEPLNVRSESKASSAPGPGRATKGPGKGPGSAYTDDGSETSEGSKPTSRADGPQKSKFASSLLKNVISKKMQREHEFKMERGEVMDTSHHLSGTSKETEGARGSERQRERGLQRQSSRHSEAGSEYTVVSMSDAGGEGSVAGSKSPVFKASTPRERNAGPGRNFTDGHTEVCEIKKSASETVKGIFLRSQNSAFRSWKEKEAEKREEQAPIGKLKLPKGGDWRADLGEISASKNTIMSRLFVPNIQQTPKDKQPRKQATKYPAAQATSTAVIRPKAPEIKIRLGSVQQPSSDFNIAKLLTPKLAGGSASNLFKTIEDNSRAQQKLFRGDNLEKVPHFQVRDIRDKSKAQGPLHQVRDVRKLIKGSGDSSDKGSVTPEQGLTGPKPRQLSAAAGGSGSLSPMVITCQAVVNQREDSMDREPRESMGKGGGSRVLNSSSPEGTVLVHRASGRLPVATIAPNKPEQGSYLPVLKIVSKASTQKTPEKLKEEEVKEEGKATKPARNALEKLTAAVRSMEELYSFNRNEWKRKSDPLPMMMDSHVLSLIASEEREGVVVADGDHDKLSKRLGEVEERGTGNKAGVVLRGAPIERLQRRNSNPSAESVSARAAAFENLARERPRSLYIPPVHKDVERTQPLQPLPPLPSNRNVFTVSASSIQKTGGVAGKFPQGPSPESPSAAKGIKSQGLRSLKISPATRAPPDEVTNRKSGSNLEKSNSDCENYLTIPLKGSSAAGELLSRPGASREGPPNSSAATLCSLPPLSARSQVPSSSKGSQVSGTSRPAWRTKPDNPRETVAAPPGPQSPEHPPTTIYHQPPLPFTLQGAQPQVLCFSPPSMPAPAPAASAPVPTDPFQQAQPQQTQRKMLLDVTTGQYYLVDTPVQPMTRRLFDPETGQYVDVPMTSQQQAVAPMSISVPPLALSPGAYGPTYMIYPGFLPTVLPTNALQPTPIARAPRGSELSPMVAEPSSKEAAATFTEAPYFMASGQSPASSTSSAPAATSQLLGAKAFAQLHGKPVISITSQPLGPRIIAPPSFDGTTMSFVVEHR

SEQ ID NO: 75932 - protein, 141 aa, Homo sapiens
  Payload ID: 15116
  Gene Symbol:
  Gene Name: RP11-77K12.1
  ENSP ID: ENSP00000457654
MEREGSGGSGGSAGLLQQILSLKVVPRVGNGTLCPNSTSLCSFPEMWYGVFLWALVSSLFFHVPAGLLALFTLRHHKYGGEYSEDDVNELVKEDEVDGEEQTQKTQGKKRKAQSIPARKRRQGGLSLEEEEEEDANSESEG

SEQ ID NO: 75933 - protein, 84 aa, Homo sapiens
  Payload ID: 15116
  Gene Symbol:
  Gene Name: RP11-77K12.1
  ENSP ID: ENSP00000457824
QQILSLKVVPRVGNGTLCPNSTSLCSFPGGEYSEDDVNELVKEDEVDGEEQTQKTQGKKRKAQSIPARKRRQGGLSLEEEEEED

SEQ ID NO: 75934 - protein, 57 aa, Homo sapiens
  Payload ID: 15117
  Gene Symbol:
  Gene Name: RP11-77K12.7
  ENSP ID: ENSP00000457544
  MOD_RES (1)..(1): Any amino acid
XLYVNGDLRLQQKQPLSCGGLDARYNISVINGTSPFAYDYDLTHIVAAYQERNESSQ

SEQ ID NO: 75935 - protein, 463 aa, Homo sapiens
  Payload ID: 15118
  Gene Symbol:
  Gene Name: RP11-793H13.10
  ENSP ID: ENSP00000466174
MGDDRPFVCNAPGCGQRFTNEDHLAVHKHKHEMTLKFGPARTDSVIIADQTPTPTRFLKNCEEVGLFNELASSFEHEFKKAADEDEKKAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLGGRQRTPPTTGCPDLWVTVALPAPGNGETWPEPSLPVSAPEVWQKYPGILEE

SEQ ID NO: 75936 - protein, 57 aa, Homo sapiens
  Payload ID: 15119
  Gene Symbol:
  Gene Name: RP11-795F19.5
  ENSP ID: ENSP00000464803
MWAAAGGLWRSRAGLRALFRSRDAALFPGCERGLHCSAVSCKNWLKKFASKTKWMKT

SEQ ID NO: 75937 - protein, 57 aa, Homo sapiens
  Payload ID: 15119
  Gene Symbol:
  Gene Name: RP11-795F19.5
  ENSP ID: ENSP00000464868
KEDHARLRALNGLLYKALTDLLCTPEVSQELYDLNVELSKVDEDLIIEVHQLFFSRM

SEQ ID NO: 75938 - protein, 57 aa, Homo sapiens; identical to SEQ ID NO: 75936
  Payload ID: 15119
  Gene Symbol:
  Gene Name: RP11-795F19.5
  ENSP ID: ENSP00000468252

SEQ ID NO: 75939 - protein, 310 aa, Homo sapiens
  Payload ID: 15120
  Gene Symbol:
  Gene Name: RP1-179P9.3
  ENSP ID: ENSP00000487717
NQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQVWHRRLKNQKSAKEGVTVLINEDKELAELRGLAAGVGLANACYAIQYVALAIIMEHLGKGTLPTQEEIENLPAFPREKLTLRLLLGSGAFGEVYEGTAVDILGVGSGEIKVAVKTLKKGSTDQEKIEF

SEQ ID NO: 75940 - protein, 116 aa, Homo sapiens
  Payload ID: 15121
  Gene Symbol:
  Gene Name: RP11-812E19.9
  ENSP ID: ENSP00000474135
MEFGLNWVFLVAIIKGAQCEVQLVESGGGLVQPGGSLRLSCPDSGFTFSNHYMSWVRQAPGKGLEWISYISGDSGYTNYADSVKGRFTISRDNANNSPYLQMNSLRAEDTAVYYCV

SEQ ID NO: 75941 - protein, 99 aa, Homo sapiens
  Payload ID: 15122
  Gene Symbol:
  Gene Name: RP11-831H9.11
  ENSP ID: ENSP00000435188
MGAPGGKINRPRTELKKKLFKRRRVLNRERRLRHRVVGAVIDQGLITRHHLKKRASSARANITLSGKKRRKLLQQIRLAQKEKTAMEVLRSCPRKSRLF

SEQ ID NO: 75942 - protein, 126 aa, Homo sapiens
  Payload ID: 15123
  Gene Symbol:
  Gene Name: RP11-834C11.12
  ENSP ID: ENSP00000476742
VSFPETPKSDSQTPSPNEIKTEQSLAGPKGSPSESEKERAKAADSSPDTSDNEAKETDGKRSRTSYTRYQTLELEKEFHFNRYLTRRRRIEIANNLCLNERQIKIWFQNRRMKWKKDSKMKSKEAL

SEQ ID NO: 75943 - protein, 107 aa, Homo sapiens
  Payload ID: 15124
  Gene Symbol:
  Gene Name: RP11-849F2.7
  ENSP ID: ENSP00000463847
MKFNPFVTSDRSKNRKRHFNAPSHIRRKIMSSPLSKELRQKYNVRSMPIRKDDEVQVVRGHYKGQQIGKVVQVYRKKYVIYIERVQREKANGTTVHVGIHPSKVVYI

SEQ ID NO: 75944 - protein, 525 aa, Homo sapiens
  Payload ID: 15125
  Gene Symbol:
  Gene Name: RP11-864I4.1
  ENSP ID: ENSP00000456163
MAAVDSDVESLPRGGFRCCLCHVTTANRPSLDAHLGGRKHRHLVELRAARKAQGLRSVFVSGFPRDVDSAQLSEYFLAFGPVASVVMDKDKGVFAIVEMGDVGAREAVLSQSQHSLGGHRLRVRPREQKEFQSPASKSPKGAAPDSHQLAKALAEAADVGAQMIKLVGLRELSEAERQLRSLVVALMQEVFTEFFPGCVVHPFGSSINSFDVHGCDLDLFLDLGDLEEPQPVPKAPESPSLDSALASPLDPQALACTPASPPDSQPPASPQDSEALDFETPSSSLAPQTPDSALASETLASPQSLPPASPLLEDREEGDLGKASELAETPKEEKAEGAAMLELVGSILRGCVPGVYRVQTVPSARRPVVKFCHRPSGLHGDVSLSNRLALHNSRFLSLCSELDGRVRPLVYTLRCWAQGRGLSGSGPLLSNYALTLLVIYFLQTRDPPVLPTVSQLTQKAGEGEQVEVDGWDCSFPRDASRLEPSINVEPLIRTARGECGGSTARGTWHPRRVPEWQSGGWLQQY

SEQ ID NO: 75945 - protein, 29 aa, Homo sapiens
  Payload ID: 15126
  Gene Symbol:
  Gene Name: RP11-872D17.8
  ENSP ID: ENSP00000431480
  MOD_RES (1)..(1): Any amino acid
XLAILLTFFHPFLVYRECRTWKESPSAIA

SEQ ID NO: 75946 - protein, 227 aa, Homo sapiens
  Payload ID: 15126
  Gene Symbol:
  Gene Name: RP11-872D17.8
  ENSP ID: ENSP00000431536
TLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYDKAKMKLPLLLALLFGAVSALHLRSETSTFETPLGAKTLPEDEETPEQEMEETPCRELEEEEEWGSGSEDASKKDGAVESISVPDMVDKNLTCPEEEDTVKVVGIPGCQTCRYLLVRSLQTFSQAW

SEQ ID NO: 75947 - protein, 85 aa, Homo sapiens; identical to SEQ ID NO: 67808
  Payload ID: 15127
  Gene Symbol:
  Gene Name: RP11-87C12.2
  ENSP ID: ENSP00000477146

SEQ ID NO: 75948 - protein, 171 aa, Homo sapiens
  Payload ID: 15128
  Gene Symbol:
  Gene Name: RP11-886H22.1
  ENSP ID: ENSP00000467396
ILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 75949 - protein, 123 aa, Homo sapiens
  Payload ID: 15129
  Gene Symbol:
  Gene Name: RP11-894J14.5
  ENSP ID: ENSP00000475819
  MOD_RES (1)..(1): Any amino acid
XLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSERPRKPWRSSGPWCPC

SEQ ID NO: 75950 - protein, 25 aa, Homo sapiens
  Payload ID: 15129
  Gene Symbol:
  Gene Name: RP11-894J14.5
  ENSP ID: ENSP00000475866
  MOD_RES (1)..(1): Any amino acid
XLLLAINGVTECFTFAAMSKEEVDR

SEQ ID NO: 75951 - protein, 33 aa, Homo sapiens
  Payload ID: 15129
  Gene Symbol:
  Gene Name: RP11-894J14.5
  ENSP ID: ENSP00000475958
  MOD_RES (1)..(1): Any amino acid
XLLLAINGVTECFTFAAMSKEEVDRLFPALSML

SEQ ID NO: 75952 - protein, 31 aa, Homo sapiens
  Payload ID: 15130
  Gene Symbol:
  Gene Name: RP11-903H12.5
  ENSP ID: ENSP00000477037
MVMGLGVLLLVFVLGLGLTPPTLAQDNSRHL

SEQ ID NO: 75953 - protein, 256 aa, Homo sapiens
  Payload ID: 15131
  Gene Symbol:
  Gene Name: RP11-934B9.3
  ENSP ID: ENSP00000450730
MDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGADLRPELPDHCAVRAGRLLAAAGPRFPGAATAALDASPVRLGMGRAASARPRLPVHRGRGERLGPGVLFSLRHLHGVCHAALGHAGRRRRGPRLLTLASAGPRAVSWATAGLTACTAAAGEHASSTGCAQDGSATC

SEQ ID NO: 75954 - protein, 63 aa, Homo sapiens
  Payload ID: 15132
  Gene Symbol:
  Gene Name: RP11-96L14.7
  ENSP ID: ENSP00000489065
MRFRRLTPGYFRVLQMQVAGELKAEPRSLLAGVVATVLAVLGLGGSCYAVWKMVGQRRVPRAP

SEQ ID NO: 75955 - protein, 63 aa, Homo sapiens; identical to SEQ ID NO: 75954
  Payload ID: 15132
  Gene Symbol:
  Gene Name: RP11-96L14.7
  ENSP ID: ENSP00000489416

SEQ ID NO: 75956 - protein, 63 aa, Homo sapiens; identical to SEQ ID NO: 75954
  Payload ID: 15132
  Gene Symbol:
  Gene Name: RP11-96L14.7
  ENSP ID: ENSP00000489429

SEQ ID NO: 75957 - protein, 118 aa, Homo sapiens
  Payload ID: 15133
  Gene Symbol:
  Gene Name: RP11-96L14.8
  ENSP ID: ENSP00000489126
MNQAFWKTYKSKVLQTLSGESEEDLAEERENPALVGSETAEPTEETFNPMSQLARRVQGVGVKGWLTMSSLFNKEDEDKLLPSEPCADQYVRVCLWWFWKGPEVPLLPGPFLLVCLSF

SEQ ID NO: 75958 - protein, 186 aa, Homo sapiens
  Payload ID: 15133
  Gene Symbol:
  Gene Name: RP11-96L14.8
  ENSP ID: ENSP00000489320
MNQAFWKTYKSKVLQTLSGESEEDLAEERENPALVGSETAEPTEETFNPMSQLARRVQGVGVKGWLTMSSLFNKEDEDKLLPSEPCADHPLAARPPSQAAAAAEARGPGFWDAFASRWQQQQAAAASMLRGTEPTPEPDPEPADEAAEEAAERPESQEAEPVAGFKWGFLTHKLAEMRVKAAPKGD

SEQ ID NO: 75959 - protein, 289 aa, Homo sapiens
  Payload ID: 15134
  Gene Symbol:
  Gene Name: RP11-96O20.4
  ENSP ID: ENSP00000455047
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNLTVNYKKNLIEVRADKQEAVFENLDKPGETQVISV

SEQ ID NO: 75960 - protein, 105 aa, Homo sapiens
  Payload ID: 15135
  Gene Symbol:
  Gene Name: RP11-977G19.10
  ENSP ID: ENSP00000446506
MKGWGWLALLLGALLGTAWARRSQDLHCGACRALVDELEWEIAQVDPKKTIQMGSFRINPDGSQSVVENASCLVLAARHASASSTNLKDILADLIPKEQARIKTF

SEQ ID NO: 75961 - protein, 263 aa, Homo sapiens
  Payload ID: 15135
  Gene Symbol:
  Gene Name: RP11-977G19.10
  ENSP ID: ENSP00000446743
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDGGTSKNRDRKGKMDVTNSAEKSRRSPAMALLTAAARLLGTKNASCLVLAARHASASSTNLKDILADLIPKEQARIKTFRQQHGKTVVGQITVDM

SEQ ID NO: 75962 - protein, 82 aa, Homo sapiens
  Payload ID: 15135
  Gene Symbol:
  Gene Name: RP11-977G19.10
  ENSP ID: ENSP00000447042
MKGWGWLALLLGALLGTAWARRSQDLHCGACRALVDELEWEIAQVDPKKTIQMGSFRINPDGSQSVVEIPEIARHGFTYCGR

SEQ ID NO: 75963 - protein, 316 aa, Homo sapiens; identical to SEQ ID NO: 1182
  Payload ID: 15136
  Gene Symbol:
  Gene Name: RP11-983G14.2
  ENSP ID: ENSP00000481382

SEQ ID NO: 75964 - protein, 211 aa, Homo sapiens
  Payload ID: 15136
  Gene Symbol:
  Gene Name: RP11-983G14.2
  ENSP ID: ENSP00000485766
  MOD_RES (1)..(1): Any amino acid
XLLGLTQSQDIQLLVFVLILIFYLIILPGNFLIIFTIRSDPGLTAPLYFFLGNLAFLDASYSFIVAPRMLVDFFSEKKVIKLACTDMFVVELLMVFNSGLMTLLCFLGLLASYAVILCHVRRAASEGKNKAMSMCTTRVIIILLMFGPAIFIYMCPFRALPADKMVSLFHTVIFPLMNPMIYTLRNQEVKTSMKRLLSRHVVCQVDFIIRN

SEQ ID NO: 75965 - protein, 512 aa, Homo sapiens
  Payload ID: 15137
  Gene Symbol:
  Gene Name: RP1-27O5.3
  ENSP ID: ENSP00000455300
MEMQSYYAKLLGELNEQRKRDFFCDCSIIVEGRIFKAHRNILFANSGYFRALLIHYIQDSGRHSTASLDIVTSDAFSIILDFLYSGKLDLCGENVIEVMSAASYLQMNDVVNFCKTYIRSSLDICRKMEKEAAVAAAVAAAAAAAAAAAAAAAHQVDSESPSSGREGTSCGTKSLVSSPAEGEKSVECLRESPCGDCGDCHPLELVVRDSLGGGSADSNLSTPPKRIEPKVEFDADEVEVDVGEQLQQYAAPLNLAHVEEALPSGQAVDLAYSNYHVKQFLEALLRNSAAPSKDDADHHFSRSLEGRPEGAGVAMSSMMDVQADWYGEDSGDVLVVPIKLHKCPFCPYTAKQKGILKRHIRSHTGERPYPCETCGKRFTRQEHLRSHALSVHRSNRPIICKGCRRTFTSHLSQGLRRFGLCDSCTCVTDTPDDDDDLMPINLSLVEASSESQEKSDTDNDWPIYVESEIGSHYVAQASLELLALSQPPASASQSAGITDGVSLCCPGRSTVA

SEQ ID NO: 75966 - protein, 140 aa, Homo sapiens
  Payload ID: 15138
  Gene Symbol:
  Gene Name: RP1-309K20.6
  ENSP ID: ENSP00000395201
  MOD_RES (1)..(1): Any amino acid
XGESLLMALKDVALSSGSACTSASLEPSYVLRAIGTDEDLAHSSIRFGIGRFTTEEEVDYTVEKCIQHVKRLREMSLKVGFNWLPTGLTWPLLLVKEIHLLFYQVCVVSAQHGCGHPFARSPNCGGDHGHSPLLLWIDHS

SEQ ID NO: 75967 - protein, 58 aa, Homo sapiens
  Payload ID: 15138
  Gene Symbol:
  Gene Name: RP1-309K20.6
  ENSP ID: ENSP00000411232
  MOD_RES (1)..(1): Any amino acid
XGESLLMALKDVALSSGSALFYQVWNWPLHYRGGSGLHSGEMHSACEASSRNESKSWF

SEQ ID NO: 75968 - protein, 161 aa, Homo sapiens
  Payload ID: 15138
  Gene Symbol:
  Gene Name: RP1-309K20.6
  ENSP ID: ENSP00000443983
  MOD_RES (1)..(1): Any amino acid
XMNGDPKHHYPGCINLSFAYVEGESLLMALKDVALSSGSACTSASLEPSYVLRAIGTDEDLAHSSIRFGIGRFTTEEEVDYTVEKCIQHVKRLREMSLKVGFNWLPTGLTWPLLLVKEIHLLFYQVCVVSAQHGCGHPFARSPNCGGDHGHSPLLLWIDHS

SEQ ID NO: 75969 - protein, 442 aa, Homo sapiens
  Payload ID: 15139
  Gene Symbol:
  Gene Name: RP13-1032I1.10
  ENSP ID: ENSP00000461324
MLPAAARPLWGPCLGLRAAAFRLARRQVPCVCAVRHMRSSGHQRCEALAGAPLDNAPKEYPPKIQQLVQDIASLTLLEISDLNELLKKTLKIQDVGLVPMGGVMSGAVPAAAAQEAVEEDIPIAKERTHFTVRLTEAKPVDKVKLIKEIKNYIQGINLVQAKKLVESLPQEIKANVAKAEAEKIKAALEATQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAGGCATFLCQPLDVLKTRLMNSKGEYQGVFHCAVETAKLGPLAFYKGLVPAGIRLIPHTVLTFVFLEQLRKNFGIKVPS

SEQ ID NO: 75970 - protein, 43 aa, Homo sapiens
  Payload ID: 15140
  Gene Symbol:
  Gene Name: RP1-317E23.6
  ENSP ID: ENSP00000457066
KELEELQNNQENSSHQKLAGLHLEKYSFPVEMMICLPNGTVMA

SEQ ID NO: 75971 - protein, 41 aa, Homo sapiens
  Payload ID: 15141
  Gene Symbol:
  Gene Name: RP1-321E8.5
  ENSP ID: ENSP00000480507
  MOD_RES (1)..(1): Any amino acid
XVTKSQPEKWDEEAQDAAGEEEKEQEKEKDAENKVKNSKGT

SEQ ID NO: 75972 - protein, 296 aa, Homo sapiens
  Payload ID: 15142
  Gene Symbol:
  Gene Name: RP13-279N23.2
  ENSP ID: ENSP00000455952
  MOD_RES (1)..(1): Any amino acid
XWEEELAKRMNLQTMVDTLQEAAQEADAIQEEMNEKIERLKAELVVFKGLMSDPMTDLDTKIQEKAMKVDMDICRRIDITAKLCDVAQQRNSEDVSKIFQVVPKKKERKVASDDDISEQDGEVNRFSDDEVGSMNITDEMKRMFNQLRETFDFDDDCDSLTWEENEDTLLLWEDFTNCNPTIDLQGEQEENLGNLIHETESFFKTRDKEYQETIGQIELELATAKSDMNRHLHEYMEMCSMKRGLDVQMETCRRLIKGSADRNSPSPSSVASSDSGSTDEIQDEFEREADVEPMVS

SEQ ID NO: 75973 - protein, 324 aa, Homo sapiens
  Payload ID: 15143
  Gene Symbol:
  Gene Name: RP13-347D8.7
  ENSP ID: ENSP00000488984
MSATGDQDLIQEDQEAPVNQEGAQAEAVGDREGGDSGPDSGNTVAGVAGPMRGLGEEEGEQAAGLAAAPGGGNAEEDSEIRIVVEMVEEEEDEEEEEEEEEEERNEADNFDLVAAARRYPIRGFRMEFLDMVHSLLLRIYHNDHILIRMRGGRLMRRRRTAAPSGSEEPRLLLVHERLGVGAAGPEGEGLGLLQEAALVPEPEVPADLAEMAREPAEEPAEEASEKPTEEAAEEPAEEASEKPTEEAAEEELAEEAAEEPAKEEPAAEEESAEEPATEEAAAPEEVTKYQHEKWDEEAQDAAGKEEKEEKEKDAENKVKNSKGT

SEQ ID NO: 75974 - protein, 169 aa, Homo sapiens
  Payload ID: 15144
  Gene Symbol:
  Gene Name: RP1-34B20.21
  ENSP ID: ENSP00000489311
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGKVTIAQGGVLPNIQAVLLPKKTESHHKAKGFRSSQWLVPSRLLASPRVGKRHASSWPPRLLERALQPPAA

SEQ ID NO: 75975 - protein, 170 aa, Homo sapiens
  Payload ID: 15144
  Gene Symbol:
  Gene Name: RP1-34B20.21
  ENSP ID: ENSP00000489536
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGKVTIAQGGVLPNIQAVLLPKKTESHHKAKAGFRSSQWLVPSRLLASPRVGKRHASSWPPRLLERALQPPAA

SEQ ID NO: 75976 - protein, 34 aa, Homo sapiens
  Payload ID: 15145
  Gene Symbol:
  Gene Name: RP13-512J5.1
  ENSP ID: ENSP00000440272
LTQGMDIQWMHVPGHSGFIGNEEADRLAREGASL

SEQ ID NO: 75977 - protein, 199 aa, Homo sapiens
  Payload ID: 15146
  Gene Symbol:
  Gene Name: RP13-582O9.6
  ENSP ID: ENSP00000428966
MMEKPAGRKKKTPTPREEADVQKSALREEKVSGDRKPPERPTVPRKPRTEPCLSPEDEEHVFDAFDASFKDDFEGVPVFIPFQRKKPYECSECGRIFKHKTDHIRHQRVHTGEKPFKCAQCGKAFRHSSDVTKHQRTHTGEKPFKCGECGKAFNCGSNLLKHQKTHTGEKPYECTHCGKAFAYSSCLIRHQKRHPRKKP

SEQ ID NO: 75978 - protein, 121 aa, Homo sapiens
  Payload ID: 15147
  Gene Symbol:
  Gene Name: RP13-672B3.2
  ENSP ID: ENSP00000442747
MPFTGERRLSLRRQDEGGLLAGAEDELAGVDATTVHQHQLRPSEVPGALRQPGSSVLVCLPGLLGEVTTAGRTSGALWTWVWGSHPPSESRTNPVRMSLTLNQARTTVSDQRAEEERGIWG

SEQ ID NO: 75979 - protein, 206 aa, Homo sapiens
  Payload ID: 15148
  Gene Symbol:
  Gene Name: RP1-37E16.12
  ENSP ID: ENSP00000477208
KRDGDDRRPRLVLSFDEEKRREYLTGFHKRKVERKKAAIEEIKQRLKEEQRKLREERHQEYLKMLAEREEALEEADELDRLVTAKTESVQYDHPNHTVTVTTISDLDLSGARLLGLTPPEGGAGDRSEEEASSTEKPTKALPRKSRDPLLSQRISSLTASLHAHSRKKVKRKHPRRAQDSKKPPRAPRTSKAQRRRLTGKARHSGE

SEQ ID NO: 75980 - protein, 83 aa, Homo sapiens
  Payload ID: 15149
  Gene Symbol:
  Gene Name: RP1-4G17.5
  ENSP ID: ENSP00000460571
MANSGLQLLGFSMALLGWVGLVACTAIPQWQMSSYAGDNIITAQAMYKGLWMDCVTQSTGMMSCKMYDSVLALSGNSVPNCSI

SEQ ID NO: 75981 - protein, 159 aa, Homo sapiens
  Payload ID: 15150
  Gene Symbol:
  Gene Name: RP1-66C13.4
  ENSP ID: ENSP00000462879
MAPLPGAELVRRPLQLYRYLLRCCQQLPTKGIQQHYKHAVRQSFRVHSDEDNPERIQQIIKRAIEDADWIMNKNSPAASIIRRGQECGLLGGQGQEEGSRAGPGSRRRLANLQEGASPGPCRQALWGGYQKLTVCPGLKAVCCVTLPHSEEHLSSNPDK

SEQ ID NO: 75982 - protein, 60 aa, Homo sapiens
  Payload ID: 15151
  Gene Symbol:
  Gene Name: RP3-369A17.6
  ENSP ID: ENSP00000455145
SIKMLVTLCQSDTEEIRNVASETLLSLGEDGRLAYEQLDKFPRDCVKVGGRHGTEVATAF

SEQ ID NO: 75983 - protein, 217 aa, Homo sapiens
  Payload ID: 15152
  Gene Symbol:
  Gene Name: RP3-461F17.3
  ENSP ID: ENSP00000476966
GFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKRCDLLCCPDLSAVAQS

SEQ ID NO: 75984 - protein, 223 aa, Homo sapiens
  Payload ID: 15152
  Gene Symbol:
  Gene Name: RP3-461F17.3
  ENSP ID: ENSP00000480420
KMAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKVSGSYLFQSKVMMAL

SEQ ID NO: 75985 - protein, 19 aa, Homo sapiens
  Payload ID: 15153
  Gene Symbol:
  Gene Name: RP3-468K18.5
  ENSP ID: ENSP00000456586
  MOD_RES (1)..(1): Any amino acid
XTEMEVHEESRQFTRFHRP

SEQ ID NO: 75986 - protein, 140 aa, Homo sapiens
  Payload ID: 15154
  Gene Symbol:
  Gene Name: RP3-468K18.7
  ENSP ID: ENSP00000400756
MDIQKSENEDDSEWEDVDDEKGDSNDDYDSAGLLSDEDCMSVPGKTHRAIADHLFWSEETKSRFTEYSMTSSVMRRNEQLTLHDERFEKFYEQYDDDEIGALDNAELEGSIQVDSNRLQEVLNDYYKEKAEKWQSGIVSL

SEQ ID NO: 75987 - protein, 144 aa, Homo sapiens
  Payload ID: 15155
  Gene Symbol:
  Gene Name: RP4-539M6.19
  ENSP ID: ENSP00000400753
  MOD_RES (1)..(1): Any amino acid
XVEAYGEFLCMFEENYPETLKRLFVVKAPKLFPVAYNLIKPFLSEDTRKKIMVLGGRWISSWTPACASSTQQWGSPAPPDHTLVPGLCIGLLLHVNLLLLPGNVDTWLPGVQRPWHLGGFELDRSLETKASRSSGCRESQKGRT

SEQ ID NO: 75988 - protein, 338 aa, Homo sapiens
  Payload ID: 15155
  Gene Symbol:
  Gene Name: RP4-539M6.19
  ENSP ID: ENSP00000415178
AVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGICYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 75989 - protein, 74 aa, Homo sapiens
  Payload ID: 15155
  Gene Symbol:
  Gene Name: RP4-539M6.19
  ENSP ID: ENSP00000416788
  MOD_RES (1)..(1): Any amino acid
XKPAVEAYGEFLCMFEENYPETLKRLFVVKAPKLFPVAYNLIKPFLSEDTRKKIMVLGGGSLCQMERMLVLGFS

SEQ ID NO: 75990 - protein, 359 aa, Homo sapiens
  Payload ID: 15156
  Gene Symbol:
  Gene Name: RP4-559A3.7
  ENSP ID: ENSP00000414068
MSVGFIGAGQLAYALARGFTAAGILSAHKIIASSPEMNLPTVSALRKMGVNLTRSNKETVKHSDVLFLAVKPHIIPFILDEIGADVQARHIVVSCAAGVTISSVEKAFMALDALADGGVKMGLPRRLAIQLGAQALLGAAKMLLDSEQHPCQLKDNVCSPGGATIHALHFLESGGFRSLLINAVEASCIRTRGGRQVPGVGGQHTPAGVRHGAAAAAQQRAGAGRAAALPGAGPQGRAAQARAAVPAQRPGPGDRRVAARPRRRLQPHLPHRLQAGVRPRERLEGLRRDRGRELLAAAEPAPAAAAATGVGAEGASGPAGVRRPQAGPLCLAGGASRAWGAPAGAAHPGPWGLWSSGRL

SEQ ID NO: 75991 - protein, 177 aa, Homo sapiens
  Payload ID: 15157
  Gene Symbol:
  Gene Name: RP4-576H24.4
  ENSP ID: ENSP00000454437
MPVPASWPHPPCPFLLLTLLLGLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRGVTHVFHVQQTEMSQTVSTGESIILSCSVPNTLP

SEQ ID NO: 75992 - protein, 140 aa, Homo sapiens
  Payload ID: 15157
  Gene Symbol:
  Gene Name: RP4-576H24.4
  ENSP ID: ENSP00000457551
  MOD_RES (1)..(1): Any amino acid
XLIYNQKEGHFPRVTTVSDLTKRNNMDFSIRISNITPADAGTYYCVKFRKGSPDHVEFKSGAGTELSVREARTVFSARSTESRASPGQAFRQSKLQVSPQCPSLPPHSTHLCLPYCCICCLNWQSLTVLEARSLKSASLD

SEQ ID NO: 75993 - protein, 172 aa, Homo sapiens
  Payload ID: 15157
  Gene Symbol:
  Gene Name: RP4-576H24.4
  ENSP ID: ENSP00000457944
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRAFFQESHMCSMCNKRRCHRLYQLGSQSS

SEQ ID NO: 75994 - protein, 84 aa, Homo sapiens
  Payload ID: 15158
  Gene Symbol:
  Gene Name: RP4-583P15.14
  ENSP ID: ENSP00000477118
  MOD_RES (1)..(1): Any amino acid
XFPHQELPRALPAAAATAGCAGLEATYSNVGLAALPGVSLAASPVVAEYARVQKRKGTHRSPQEPQQGKTEVTPAAQGSSVGGG

SEQ ID NO: 75995 - protein, 417 aa, Homo sapiens
  Payload ID: 15159
  Gene Symbol:
  Gene Name: RP4-583P15.15
  ENSP ID: ENSP00000476393
  MOD_RES (1)..(1): Any amino acid
XARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 75996 - protein, 169 aa, Homo sapiens
  Payload ID: 15159
  Gene Symbol:
  Gene Name: RP4-583P15.15
  ENSP ID: ENSP00000477596
  MOD_RES (1)..(1): Any amino acid
XRALSLRLFQTEEKIERTQRDIRSIQEALARNAGRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKG

SEQ ID NO: 75997 - protein, 290 aa, Homo sapiens
  Payload ID: 15159
  Gene Symbol:
  Gene Name: RP4-583P15.15
  ENSP ID: ENSP00000488802
  MOD_RES (1)..(1): Any amino acid
XFSHGQVVSLDELRPFQDPDLSSLQAGSACLAKHQDGLWHAARITDVDNGYYTVKFDSLLLREAVVEGDGILPPLRTEATESDSDSDGTGDSSYARGMAAAAEPRSQEGPRLHRMGLPVSWAPPALWVLGCCALLLSLWALCTACRRPEDAVAPRKRARRQRARLQGSATAAEAQVGHQTARAAPGPAQQQGPAACQHGSPAPTLAGGVQGHHRTAGSPLCLPTPGAAPGSAGSCSHRRVRWPRGHLFQRGAGGPSRGQPGGQPCGGRVCPRPEAQRDPSQSPRATAGED

SEQ ID NO: 75998 - protein, 83 aa, Homo sapiens
  Payload ID: 15160
  Gene Symbol:
  Gene Name: RP4-613B23.5
  ENSP ID: ENSP00000406044
MSTDTGVSLPSYEEDQGSKLIRKAKEAPFVPVGIAGFAAIVAYGLYKLKSRGNTKMSIHLIHMRVAAQGFVVGAMTVGQDGSR

SEQ ID NO: 75999 - protein, 110 aa, Homo sapiens
  Payload ID: 15161
  Gene Symbol:
  Gene Name: RP4-614O4.11
  ENSP ID: ENSP00000489186
GSYCVFSNQGGLVHPKTSIEDQDELSSLLQVPLVAGTVNRGSEVIAAGMVVNDWCAFCGLDTTSTELSVVESVFKLNEAQPSTIATSMRDSLIDRLGNSRRPWSTLRISV

SEQ ID NO: 76000 - protein, 61 aa, Homo sapiens
  Payload ID: 15162
  Gene Symbol:
  Gene Name: RP4-635E18.9
  ENSP ID: ENSP00000478249
  MOD_RES (1)..(1): Any amino acid
XEDLIIKGISVHISNAEPKHNSNRQLERSGRFGGNPALALLLSSSNMVTLKMVLGDLQRLN

SEQ ID NO: 76001 - protein, 16 aa, Homo sapiens
  Payload ID: 15162
  Gene Symbol:
  Gene Name: RP4-635E18.9
  ENSP ID: ENSP00000480398
LISNVYGRSTSLKVVL

SEQ ID NO: 76002 - protein, 89 aa, Homo sapiens
  Payload ID: 15162
  Gene Symbol:
  Gene Name: RP4-635E18.9
  ENSP ID: ENSP00000481737
  MOD_RES (1)..(1): Any amino acid
XREFFSQYGDVMDVFIPKPFRAFAFVTFADDQIAQSLCGEDLIIKGISVHISNAEPKHNSNRQLERSGRFGVHLISNVYGRSTSLKVVL

SEQ ID NO: 76003 - protein, 298 aa, Homo sapiens
  Payload ID: 15162
  Gene Symbol:
  Gene Name: RP4-635E18.9
  ENSP ID: ENSP00000481867
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPVHLISNVYGRSTSLKVVL

SEQ ID NO: 76004 - protein, 113 aa, Homo sapiens
  Payload ID: 15163
  Gene Symbol:
  Gene Name: RP4-734P14.4
  ENSP ID: ENSP00000456213
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLDGGQEQQDAAAY

SEQ ID NO: 76005 - protein, 103 aa, Homo sapiens
  Payload ID: 15164
  Gene Symbol:
  Gene Name: RP4-777O23.3
  ENSP ID: ENSP00000470615
MNKSNLNSLDEQEGVKSGMYVVIEVKVATQEGKEITCRSYLMTNYESAPPSPQYKKIICMGAKENGLPLEYQEKLKAIEPNDYTGKVSEEIEDIIKKGETQTL

SEQ ID NO: 76006 - protein, 287 aa, Homo sapiens
  Payload ID: 15165
  Gene Symbol:
  Gene Name: RP5-1021I20.4
  ENSP ID: ENSP00000451484
MIVQRVVLNSRPGKNGNPVAENFRMEEVYLPDNINEGQVQVRTLYLSVDPYMRCRMNEDTGTDYITPWQLSQVVDGGGIGIIEESKHTNLTKGDFVTSFYWPWQTKVILDGNSLEKVDPQLVDGHLSYFLGAIGMPGLTSLIGIQEKGHITAGSNKTMVVSGAAGACGSVAGQMNENSHIILCGQISQYNKDVPYPPPLSPAIEAIQKERNITRERFLVLNYKDKFEPGILQLSQWFKEGKLKIKETVINGLENMGAAFQSMMTGGYIDYPPSTTSYGKSIVFPRGI

SEQ ID NO: 76007 - protein, 57 aa, Homo sapiens
  Payload ID: 15166
  Gene Symbol:
  Gene Name: RP5-1042K10.14
  ENSP ID: ENSP00000476535
  MOD_RES (1)..(1): Any amino acid
XFTGRASQQVQRFLEEEVYPLLKPYESVMKVVTRFKMKKVQNEYEVKVSLPPSSPNM

SEQ ID NO: 76008 - protein, 56 aa, Homo sapiens
  Payload ID: 15166
  Gene Symbol:
  Gene Name: RP5-1042K10.14
  ENSP ID: ENSP00000485211
IERIQVDAYFSPIHSQLDHLLDPSSFTGRASQQVQRFLEEEVYPLLKPYESVMKGR

SEQ ID NO: 76009 - protein, 303 aa, Homo sapiens
  Payload ID: 15167
  Gene Symbol:
  Gene Name: RP5-1052I5.2
  ENSP ID: ENSP00000359579
MLFIKFIHLEVFSMPERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTAPDTATPSHRHGPICGSKSISSLLVKVSPVCKDSHCLGKCSRNGLSAV

SEQ ID NO: 76010 - protein, 94 aa, Homo sapiens
  Payload ID: 15168
  Gene Symbol:
  Gene Name: RP5-850E9.3
  ENSP ID: ENSP00000474279
MPRSFLVKKIKGDGFQCSGVPAPTYHPLETAYVLPGARGPPGDNDGVQKVSATGGRQSRNSWLPPSSPVFSSWQGGPRQRAPHRCPLDQRGPGR

SEQ ID NO: 76011 - protein, 254 aa, Homo sapiens
  Payload ID: 15169
  Gene Symbol:
  Gene Name: RP5-860F19.8
  ENSP ID: ENSP00000369967
MTRLCLPRPEAREDPIPVPPRGLGAGEGSGSPVRPPVSTWGPSWAQLLDSVLWLGALGLTIQAVFSTTGPALLLLLVSFLTFDLLHRCTRHDAAAASGDRYHRGWRGATAGSALVSLGHEAWLGALVGEPHAPELDPVVEHLELAATAAAPAVGSGGDTLPAAGTDVVPCTLHHWLPPAELLVACRGRGVAPPATGSPAAGAQCSACPPLHGLLPAALLHTAEPCGPPHLHDSPRRHSGFGSIEGQPHPTACVC

SEQ ID NO: 76012 - protein, 514 aa, Homo sapiens
  Payload ID: 15170
  Gene Symbol:
  Gene Name: RP5-864K19.6
  ENSP ID: ENSP00000406846
MGDWNLLGDTLEEVHIHSTMIGKIWLTILFIFRMLVLGVAAEDVWNDEQSGFICNTEQPGCRNVCYDQAFPISLIRYWVLQVIFVSSPSLVYMGHALYRLRVLEEERQRMKAQLRVELEEVEFEMPRDRRRLEQELCQLEKRKLNKAPLRGTLLCTYVIHIFTRSVVEVGFMIGQYLLYGFHLEPLFKCHGHPCPNIIDCFVSRPTEKTIFLLFMQSIATISLFLNILEIFHLGFKKIKRGLWGKYKLKKEHNEFHANKAKQNVAKYQSTSANSLKRLPSAPDYNLLVEKQTHTAVYPSLNSSSVFQPNPDNHSVNDEKCILDEQETVLSNEISTLSTSCSHFQHISSNNNKDTHKIFGKELNGNQLMEKRETEGKDSKRNYYSRGHRSIPGVAIDGENNMRQSPQTVFSLPANCDWKPRWLRATWGSSTEHENRGSPPKVPGSKATASSLLLILQRPTSSQPRLKETPKIKAEAKIYDSKHPPRLLQSTVSTFSGREPRSPAPMGHHSFRGPR

SEQ ID NO: 76013 - protein, 110 aa, Homo sapiens
  Payload ID: 15170
  Gene Symbol:
  Gene Name: RP5-864K19.6
  ENSP ID: ENSP00000479064
MVCFSDLPKLRKAADSKREQFRRYLEKSGVLDTLTKVLVALYEEPEKPNSALDFLKHHLGAATPENPEIELLRLELAEMKEKYEAIVEENKKLKAKLAQYEPPQEEKRAE

SEQ ID NO: 76014 - protein, 84 aa, Homo sapiens
  Payload ID: 15171
  Gene Symbol:
  Gene Name: RP5-874C20.8
  ENSP ID: ENSP00000481142
MATALDPDQPKKQKILVEEMAPLKGVQEQQVRHECEVTKPEKEKASDDPEDRHLPLCWFSIEMMYINLGRACTVRMGLGSGGGE

SEQ ID NO: 76015 - protein, 449 aa, Homo sapiens
  Payload ID: 15172
  Gene Symbol:
  Gene Name: RP5-877J2.1
  ENSP ID: ENSP00000421315
  MOD_RES (1)..(1): Any amino acid
XETLTLHSLTCYEDLVTFLQQSIHQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTNIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 76016 - protein, 96 aa, Homo sapiens
  Payload ID: 15173
  Gene Symbol:
  Gene Name: RP5-966M1.6
  ENSP ID: ENSP00000422253
MSQAGAQEAPIKKKRPPVKDEDLKGARGNLTKNQEIKSKTYQVMRECEQAGSAAPSVFSRTRTERFLSPAVSGAATLPHSPGPSAKGSAPAPWKHQ

SEQ ID NO: 76017 - protein, 279 aa, Homo sapiens
  Payload ID: 15174
  Gene Symbol:
  Gene Name: RP5-972B16.2
  ENSP ID: ENSP00000417050
MGRVFLTGEKANSILKRYPRANGFFEEIRQGNIERECKEEFCTFEEAREAFENNEKTITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 76018 - protein, 37 aa, Homo sapiens
  Payload ID: 15175
  Gene Symbol:
  Gene Name: RP6-24A23.6
  ENSP ID: ENSP00000457111
RRVPRPPEREDSDNDDDTHVRMDFARRDNQFDSPKRE

SEQ ID NO: 76019 - protein, 148 aa, Homo sapiens
  Payload ID: 15176
  Gene Symbol: RPAIN
  Gene Name: RPA interacting protein
  ENSP ID: ENSP00000315069
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKPVILGL

SEQ ID NO: 76020 - protein, 172 aa, Homo sapiens
  Payload ID: 15176
  Gene Symbol: RPAIN
  Gene Name: RPA interacting protein
  ENSP ID: ENSP00000370605
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKYNLRITSGVVVCQCGLSIPSHACDTWAVIL

SEQ ID NO: 76021 - protein, 219 aa, Homo sapiens
  Payload ID: 15176
  Gene Symbol: RPAIN
  Gene Name: RPA interacting protein
  ENSP ID: ENSP00000370606
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKYNLRITSGVVVCQCGLSIPSHSSELTEQKLRACLEGSINEHSAHCPHTPEFSVTGGTEEKSSLLMSCLACDTWAVIL

SEQ ID NO: 76022 - protein, 231 aa, Homo sapiens
  Payload ID: 15176
  Gene Symbol: RPAIN
  Gene Name: RPA interacting protein
  ENSP ID: ENSP00000385814
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTKYNLRITSGVVVCQCGLSIPSHSSELTEQKLRACLEGSINEHSAHCPHTPEFSVTGGTEEKSSLLMSCLVSVSWDPLCGKRDLWLVLFPP

SEQ ID NO: 76023 - protein, 106 aa, Homo sapiens
  Payload ID: 15176
  Gene Symbol: RPAIN
  Gene Name: RPA interacting protein
  Uniprot ID: Q86UA6
  ENSP ID: ENSP00000439939
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQGL

SEQ ID NO: 76024 - protein, 145 aa, Homo sapiens
  Payload ID: 15176
  Gene Symbol: RPAIN
  Gene Name: RPA interacting protein
  Uniprot ID: Q86UA6
  ENSP ID: ENSP00000446453
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQEQSIISEYEKSLQFDEKCLSIMLAEWEANPLICPVCTNLLS

SEQ ID NO: 76025 - protein, 106 aa, Homo sapiens
  Payload ID: 15176
  Gene Symbol: RPAIN
  Gene Name: RPA interacting protein
  ENSP ID: ENSP00000458218
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQVF

SEQ ID NO: 76026 - protein, 107 aa, Homo sapiens
  Payload ID: 15176
  Gene Symbol: RPAIN
  Gene Name: RPA interacting protein
  ENSP ID: ENSP00000458699
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQGTT

SEQ ID NO: 76027 - protein, 107 aa, Homo sapiens; identical to SEQ ID NO: 76026
  Payload ID: 15176
  Gene Symbol: RPAIN
  Gene Name: RPA interacting protein
  ENSP ID: ENSP00000460162

SEQ ID NO: 76028 - protein, 107 aa, Homo sapiens; identical to SEQ ID NO: 76026
  Payload ID: 15176
  Gene Symbol: RPAIN
  Gene Name: RPA interacting protein
  ENSP ID: ENSP00000460354

SEQ ID NO: 76029 - protein, 106 aa, Homo sapiens; identical to SEQ ID NO: 76025
  Payload ID: 15176
  Gene Symbol: RPAIN
  Gene Name: RPA interacting protein
  ENSP ID: ENSP00000467178

SEQ ID NO: 76030 - protein, 1235 aa, Homo sapiens
  Payload ID: 15177
  Gene Symbol: RPGRIP1L
  Gene Name: RPGRIP1-like
  Uniprot ID: Q68CZ1
  ENSP ID: ENSP00000262135
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDVSQEGSVDEVKENTEKMQQGKDDVSLLSEGQLAEQSLASSEDETEITEDLEPEVEEDMSASDSDDCIIPGPISKNIKQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 76031 - protein, 1315 aa, Homo sapiens
  Payload ID: 15177
  Gene Symbol: RPGRIP1L
  Gene Name: RPGRIP1-like
  Uniprot ID: Q68CZ1
  ENSP ID: ENSP00000369257
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDETSPPPEDRKEISPEVEHIPEIEINMLTVPHVPKVSQEGSVDEVKENTEKMQQGKDDVSLLSEGQLAEQSLASSEDETEITEDLEPEVEEDMSASDSDDCIIPGPISKNIKQSLALSPGLGCSSAISAHCNFRLPGSSDFPASASQVDGITGACHHTQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 76032 - protein, 354 aa, Homo sapiens
  Payload ID: 15177
  Gene Symbol: RPGRIP1L
  Gene Name: RPGRIP1-like
  ENSP ID: ENSP00000455295
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKE

SEQ ID NO: 76033 - protein, 125 aa, Homo sapiens
  Payload ID: 15177
  Gene Symbol: RPGRIP1L
  Gene Name: RPGRIP1-like
  ENSP ID: ENSP00000455451
MSGPTDETAGDLPVKDTGLNLFGMGGLQETSTTRTMKSRQAVSRVSREELEDRFLRLHDENILLKQHARKQEDKIKRFKEKVRQPLKNENRVFLLRIHPKEVVPVQFLLCGLQQPTGMLCAGLLL

SEQ ID NO: 76034 - protein, 1253 aa, Homo sapiens
  Payload ID: 15177
  Gene Symbol: RPGRIP1L
  Gene Name: RPGRIP1-like
  ENSP ID: ENSP00000456534
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDETSPPPEDRKEISPEVEHIPEIEINMLTVPHVPKVSQEGSVDEVKENTEKMQQGKDDVSLLSEGQLAEQSLASSEDETEITEDLEPEVEEDMSASDSDDCIIPGPISKNIKQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDGMGESVAQFVQPTIAELQTLY

SEQ ID NO: 76035 - protein, 1281 aa, Homo sapiens
  Payload ID: 15177
  Gene Symbol: RPGRIP1L
  Gene Name: RPGRIP1-like
  ENSP ID: ENSP00000457889
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDVSQEGSVDEVKENTEKMQQGKDDVSLLSEGQLAEQSLASSEDETEITEDLEPEVEEDMSASDSDDCIIPGPISKNIKQSLALSPGLGCSSAISAHCNFRLPGSSDFPASASQVDGITGACHHTQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 76036 - protein, 78 aa, Homo sapiens
  Payload ID: 15177
  Gene Symbol: RPGRIP1L
  Gene Name: RPGRIP1-like
  ENSP ID: ENSP00000458705
MSGPTDETAGDLPVKDTGLNLFGMGGLQETSTTRTMKSRQAVSRVSREELEDRFLRLHDENILLKQHARKQEDKIKRL

SEQ ID NO: 76037 - protein, 122 aa, Homo sapiens
  Payload ID: 15177
  Gene Symbol: RPGRIP1L
  Gene Name: RPGRIP1-like
  ENSP ID: ENSP00000459817
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHEL

SEQ ID NO: 76038 - protein, 56 aa, Homo sapiens
  Payload ID: 15177
  Gene Symbol: RPGRIP1L
  Gene Name: RPGRIP1-like
  ENSP ID: ENSP00000463678
MSGPTDETAGDLPVKDTGLNLFGMGGLQETSTTRTMKSRQAVSRVSREELEDRFLR

SEQ ID NO: 76039 - protein, 1269 aa, Homo sapiens
  Payload ID: 15177
  Gene Symbol: RPGRIP1L
  Gene Name: RPGRIP1-like
  ENSP ID: ENSP00000480698
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDETSPPPEDRKEISPEVEHIPEIEINMLTVPHVPKVSQEGSVDEVKENTEKMQQGKDDVSLLSEGQLAEQSLASSEDETEITEDLEPEVEEDMSASDSDDCIIPGPISKNIKQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 76040 - protein, 190 aa, Homo sapiens
  Payload ID: 15178
  Gene Symbol: RPL17-C18orf32
  Gene Name: RPL17-C18orf32 readthrough
  ENSP ID: ENSP00000352143
MHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKLRSSSLGKWCAFLVSSFQFCSGSTKNSWSHIYTLWFPPSLVVYGLRKQYKNPMIQTKAK

SEQ ID NO: 76041 - protein, 184 aa, Homo sapiens [sequence omitted]

SEQ ID NO: 76042 - protein, 228 aa, Homo sapiens
  Payload ID: 15178
  Gene Symbol: RPL17-C18orf32
  Gene Name: RPL17-C18orf32 readthrough
  ENSP ID: ENSP00000463379
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKLRSSSLGKWCAFLVSSFQFCSGSTKNSWSHIYTLWFPPSLVVYGLRKQYKNPMIQTKAK

SEQ ID NO: 76043 - protein, 118 aa, Homo sapiens
  Payload ID: 15179
  Gene Symbol: RPL36A-HNRNPH2
  Gene Name: RPL36A-HNRNPH2 readthrough
  ENSP ID: ENSP00000386655
MVNVPKTRRTFCKKCGKHQPHKVTQYKKGKDSLYAQGKRRYDRKQSGYGGQTKPIFRKKAKTTKKIVLRLECVEPNCRSKRMLAIKRCKHFELGGDKKRKLHQNCIEPNLPPRAQQSP

SEQ ID NO: 76044 - protein, 77 aa, Homo sapiens
  Payload ID: 15179
  Gene Symbol: RPL36A-HNRNPH2
  Gene Name: RPL36A-HNRNPH2 readthrough
  ENSP ID: ENSP00000386974
MVNVPKTRRTFCKKCGKHQPHKVTQYKKGKDSLYAQGKRRYDRKQSGYGGQTKPIFRKKLHQNCIEPNLPPRAQQSP

SEQ ID NO: 76045 - protein, 286 aa, Homo sapiens
  Payload ID: 15180
  Gene Symbol: RPS10-NUDT3
  Gene Name: RPS10-NUDT3 readthrough
  ENSP ID: ENSP00000475027
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFVLLVSSSRHPDRWIVPGGGMEPEEEPSVAAVREVCEEAGVKGTLGRLVGIFENQERKHRTYVYVLIVTEVLEDWEDSVNIGRKREWFKIEDAIKVLQYHKPVQASYFETLRQGYSANNGTPVVATTYSVSAQSS

SEQ ID NO: 76046 - protein, 1732 aa, Homo sapiens
  Payload ID: 15181
  Gene Symbol: RICTOR
  Gene Name: RPTOR independent companion of MTOR, complex 2
  Uniprot ID: Q6R327
  ENSP ID: ENSP00000296782
MAAIGRGRSLKNLRVRGRNDSGEENVPLDLTREPSDNLREILQNVARLQGVSNMRKLGHLNNFTKLLCDIGHSEEKLGFHYEDIIICLRLALLNEAKEVRAAGLRALRYLIQDSSILQKVLKLKVDYLIARCIDIQQSNEVERTQALRLVRKMITVNASLFPSSVTNSLIAVGNDGLQERDRMVRACIAIICELALQNPEVVALRGGLNTILKNVIDCQLSRINEALITTILHLLNHPKTRQYVRADVELERILAPYTDFHYRHSPDTAEGQLKEDREARFLASKMGIIATFRSWAGIINLCKPGNSGIQSLIGVLCIPNMEIRRGLLEVLYDIFRLPLPVVTEEFIEALLSVDPGRFQDSWRLSDGFVAAEAKTILPHRARSRPDLMDNYLALILSAFIRNGLLEGLVEVITNSDDHISVRATILLGELLHMANTILPHSHSHHLHCLPTLMNMAASFDIPKEKRLRASAALNCLKRFHEMKKRGPKPYSLHLDHIIQKAIATHQKRDQYLRVQKDIFILKDTEEALLINLRDSQVLQHKENLEWNWNLIGTILKWPNVNLRNYKDEQLHRFVRRLLYFYKPSSKLYANLDLDFAKAKQLTVVGCQFTEFLLESEEDGQGYLEDLVKDIVQWLNASSGMKPERSLQNNGLLTTLSQHYFLFIGTLSCHPHGVKMLEKCSVFQCLLNLCSLKNQDHLLKLTVSSLDYSRDGLARVILSKILTAATDACRLYATKHLRVLLRANVEFFNNWGIELLVTQLHDKNKTISSEALDILDEACEDKANLHALIQMKPALSHLGDKGLLLLLRFLSIPKGFSYLNERGYVAKQLEKWHREYNSKYVDLIEEQLNEALTTYRKPVDGDNYVRRSNQRLQRPHVYLPIHLYGQLVHHKTGCHLLEVQNIITELCRNVRTPDLDKWEEIKKLKASLWALGNIGSSNWGLNLLQEENVIPDILKLAKQCEVLSIRGTCVYVLGLIAKTKQGCDILKCHNWDAVRHSRKHLWPVVPDDVEQLCNELSSIPSTLSLNSESTSSRHNSESESVPSSMFILEDDRFGSSSTSTFFLDINEDTEPTFYDRSGPIKDKNSFPFFASSKLVKNRILNSLTLPNKKHRSSSDPKGGKLSSESKTSNRRIRTLTEPSVDFNHSDDFTPISTVQKTLQLETSFMGNKHIEDTGSTPSIGENDLKFTKNFGTENHRENTSRERLVVESSTSSHMKIRSQSFNTDTTTSGISSMSSSPSRETVGVDATTMDTDCGSMSTVVSTKTIKTSHYLTPQSNHLSLSKSNSVSLVPPGSSHTLPRRAQSLKAPSIATIKSLADCNFSYTSSRDAFGYATLKRLQQQRMHPSLSHSEALASPAKDVLFTDTITMKANSFESRLTPSRIDFKKKHVGGIRSLRPTITNNLFRFMKALSYASLDKEDLLSPINQNTLQRSSSVRSMVSSATYGGSDDYIGLALPVDINDIFQVKDIPYFQTKNIPPHDDRGARAFAHDAGGLPSGTGGLVKNSFHLLRQQMSLTEIMNSIHSDASLFLESTEDTGLQEHTDDNCLYCVCIEILGFQPSNQLSAICSHSDFQDIPYSDWCEQTIHNPLEVVPSKFSGISGCSDGVSQEGSASSTKSTELLLGVKTIPDDTPMCRILLRKEVLRLVINLSSSVSTKCHETGLLTIKEKYPQTFDDICLYSEVSHLLSHCTFRLPCRRFIQELFQDVQFLQMHEEAEAVLATPPKQPIVDTSAES

SEQ ID NO: 76047 - protein, 1708 aa, Homo sapiens
  Payload ID: 15181
  Gene Symbol: RICTOR
  Gene Name: RPTOR independent companion of MTOR, complex 2
  Uniprot ID: Q6R327
  ENSP ID: ENSP00000349959
MAAIGRGRSLKNLRVRGRNDSGEENVPLDLTREPSDNLREILQNVARLQGVSNMRKLGHLNNFTKLLCDIGHSEEKLGFHYEDIIICLRLALLNEAKEVRAAGLRALRYLIQDSSILQKVLKLKVDYLIARCIDIQQSNEVERTQALRLVRKMITVNASLFPSSVTNSLIAVGNDGLQERDRMVRACIAIICELALQNPEVVALRGGLNTILKNVIDCQLSRINEALITTILHLLNHPKTRQYVRADVELERILAPYTDFHYRHSPDTAEGQLKEDREARFLASKMGIIATFRSWAGIINLCKPGNSGIQSLIGVLCIPNMEIRRGLLEVLYDIFRLPLPVVTEEFIEALLSVDPGRFQDSWRLSDGFVAAEAKTILPHRARSRPDLMDNYLALILSAFIRNGLLEGLVEVITNSDDHISVRATILLGELLHMANTILPHSHSHHLHCLPTLMNMAASFDIPKEKRLRASAALNCLKRFHEMKKRGPKPYSLHLDHIIQKAIATHQKRDQYLRVQKDIFILKDTEEALLINLRDSQVLQHKENLEWNWNLIGTILKWPNVNLRNYKDEQLHRFVRRLLYFYKPSSKLYANLDLDFAKAKQLTVVGCQFTEFLLESEEDGQGYLEDLVKDIVQWLNASSGMKPERSLQNNGLLTTLSQHYFLFIGTLSCHPHGVKMLEKCSVFQCLLNLCSLKNQDHLLKLTVSSLDYSRDGLARVILSKILTAATDACRLYATKHLRVLLRANVEFFNNWGIELLVTQLHDKNKTISSEALDILDEACEDKANLHALIQMKPALSHLGDKGLLLLLRFLSIPKGFSYLNERGYVAKQLEKWHREYNSKYVDLIEEQLNEALTTYRKPVDGDNYVRRSNQRLQRPHVYLPIHLYGQLVHHKTGCHLLEVQNIITELCRNVRTPDLDKWEEIKKLKASLWALGNIGSSNWGLNLLQEENVIPDILKLAKQCEVLSIRGTCVYVLGLIAKTKQGCDILKCHNWDAVRHSRKHLWPVVPDDVEQLCNELSSIPSTLSLNSESTSSRHNSESESVPSSMFILEDDRFGSSSTSTFFLDINEDTEPTFYDRSGPIKDKNSFPFFASSKLVKNRILNSLTLPNKKHRSSSDPKGGKLSSESKTSNRRIRTLTEPSVDFNHSDDFTPISTVQKTLQLETSFMGNKHIEDTGSTPSIGENDLKFTKNFGTENHRENTSRERLVVESSTSSHMKIRSQSFNTDTTTSGISSMSSSPSRETVGVDATTMDTDCGSMSTVVSTKTIKTSHYLTPQSNHLSLSKSNSVSLVPPGSSHTLPRRAQSLKAPSIATIKSLADCNFSYTSSRDAFGYATLKRLQQQRMHPSLSHSEALASPAKDVLFTDTITMKANSFESRLTPSRFMKALSYASLDKEDLLSPINQNTLQRSSSVRSMVSSATYGGSDDYIGLALPVDINDIFQVKDIPYFQTKNIPPHDDRGARAFAHDAGGLPSGTGGLVKNSFHLLRQQMSLTEIMNSIHSDASLFLESTEDTGLQEHTDDNCLYCVCIEILGFQPSNQLSAICSHSDFQDIPYSDWCEQTIHNPLEVVPSKFSGISGCSDGVSQEGSASSTKSTELLLGVKTIPDDTPMCRILLRKEVLRLVINLSSSVSTKCHETGLLTIKEKYPQTFDDICLYSEVSHLLSHCTFRLPCRRFIQELFQDVQFLQMHEEAEAVLATPPKQPIVDTSAES

SEQ ID NO: 76048 - protein, 257 aa, Homo sapiens
  Payload ID: 15181
  Gene Symbol: RICTOR
  Gene Name: RPTOR independent companion of MTOR, complex 2
  Uniprot ID: Q6R327
  ENSP ID: ENSP00000423019
MAAIGRGRSLKNLRVRGRNDSGEENVPLDLTREPSDNLREILQNVARLQGVSNMRKLGHLNNFTKLLCDIGHSEEKLGFHYEDIIICLRLALLNEAKEVRAAGLRALRYLIQDSSILQKVLKLKVDYLIARCIDIQQSNEVERTQALRLVRKMITVNASLFPSSVTNSLIAVGNDGLQERDRMVRACIAIICELALQNPEVVALRGGLNTILKNVIDCQLSRINEALITTILHLLNHPKTRQYVRADVELENFSTLY

SEQ ID NO: 76049 - protein, 224 aa, Homo sapiens
  Payload ID: 15181
  Gene Symbol: RICTOR
  Gene Name: RPTOR independent companion of MTOR, complex 2
  ENSP ID: ENSP00000423162
MAAIGRGRSLKNLRVREPSDNLREILQNVARLQGVSNMRKLGHLNNFTKLLCDIGHSEEKLGFHYEDIIICLRLALLNEAKEVRAAGLRALRYLIQDSSILQKVLKLKVDYLIARCIDIQQSNEVERTQALRLVRKMITVNASLFPSSVTNSLIAVGNDGLQERDRMVRACIAIICELALQNPEVVALRGGLNTILKNVIDCQLSRINEALITTILHLLNHPKT

SEQ ID NO: 76050 - protein, 651 aa, Homo sapiens
  Payload ID: 15182
  Gene Symbol: RRN3
  Gene Name: RRN3 homolog, RNA polymerase I transcription factor
  Uniprot ID: Q9NYV6
  ENSP ID: ENSP00000198767
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 76051 - protein, 618 aa, Homo sapiens
  Payload ID: 15182
  Gene Symbol: RRN3
  Gene Name: RRN3 homolog, RNA polymerase I transcription factor
  Uniprot ID: Q9NYV6
  ENSP ID: ENSP00000318484
MRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 76052 - protein, 621 aa, Homo sapiens
  Payload ID: 15182
  Gene Symbol: RRN3
  Gene Name: RRN3 homolog, RNA polymerase I transcription factor
  ENSP ID: ENSP00000402027
MAAPLLHTRLPGDAAASSSAVKKLGASRTGISNMRALENDFFNSPPRKTVRFGGTVTEVLLKYKKGETNDFELLKNQLLDPDIKRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 76053 - protein, 305 aa, Homo sapiens
  Payload ID: 15182
  Gene Symbol: RRN3
  Gene Name: RRN3 homolog, RNA polymerase I transcription factor
  Uniprot ID: Q9NYV6
  ENSP ID: ENSP00000454238
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMVSSLLMKVEMKFIIKGGNS

SEQ ID NO: 76054 - protein, 638 aa, Homo sapiens
  Payload ID: 15182
  Gene Symbol: RRN3
  Gene Name: RRN3 homolog, RNA polymerase I transcription factor
  ENSP ID: ENSP00000454530
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSF

SEQ ID NO: 76055 - protein, 651 aa, Homo sapiens; identical to SEQ ID NO: 76050
  Payload ID: 15182
  Gene Symbol: RRN3
  Gene Name: RRN3 homolog, RNA polymerase I transcription factor
  Uniprot ID: Q9NYV6
  ENSP ID: ENSP00000480743

SEQ ID NO: 76056 - protein, 638 aa, Homo sapiens; identical to SEQ ID NO: 76054
  Payload ID: 15182
  Gene Symbol: RRN3
  Gene Name: RRN3 homolog, RNA polymerase I transcription factor
  ENSP ID: ENSP00000487746

SEQ ID NO: 76057 - protein, 305 aa, Homo sapiens; identical to SEQ ID NO: 76053
  Payload ID: 15182
  Gene Symbol: RRN3
  Gene Name: RRN3 homolog, RNA polymerase I transcription factor
  Uniprot ID: Q9NYV6
  ENSP ID: ENSP00000487821

SEQ ID NO: 76058 - protein, 621 aa, Homo sapiens; identical to SEQ ID NO: 76052
  Payload ID: 15182
  Gene Symbol: RRN3
  Gene Name: RRN3 homolog, RNA polymerase I transcription factor
  ENSP ID: ENSP00000487970

SEQ ID NO: 76059 - protein, 618 aa, Homo sapiens; identical to SEQ ID NO: 76051
  Payload ID: 15182
  Gene Symbol: RRN3
  Gene Name: RRN3 homolog, RNA polymerase I transcription factor
  Uniprot ID: Q9NYV6
  ENSP ID: ENSP00000488651

SEQ ID NO: 76060 - protein, 263 aa, Homo sapiens
  Payload ID: 15183
  Gene Symbol: RSPO1
  Gene Name: R-spondin 1
  Uniprot ID: Q2MKA7
  ENSP ID: ENSP00000348944
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 76061 - protein, 263 aa, Homo sapiens; identical to SEQ ID NO: 76060
  Payload ID: 15183
  Gene Symbol: RSPO1
  Gene Name: R-spondin 1
  Uniprot ID: Q2MKA7
  ENSP ID: ENSP00000383846

SEQ ID NO: 76062 - protein, 200 aa, Homo sapiens
  Payload ID: 15183
  Gene Symbol: RSPO1
  Gene Name: R-spondin 1
  Uniprot ID: Q2MKA7
  ENSP ID: ENSP00000479832
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPGQKRRKGGQGRRENANRNLARKESKEAGAGSRRRKGQQQQQQQGTVGPLTSAGPA

SEQ ID NO: 76063 - protein, 236 aa, Homo sapiens
  Payload ID: 15183
  Gene Symbol: RSPO1
  Gene Name: R-spondin 1
  Uniprot ID: Q2MKA7
  ENSP ID: ENSP00000481178
MIFRVSAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 76064 - protein, 243 aa, Homo sapiens
  Payload ID: 15184
  Gene Symbol: RSPO2
  Gene Name: R-spondin 2
  Uniprot ID: Q6UXX9
  ENSP ID: ENSP00000276659
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 76065 - protein, 179 aa, Homo sapiens
  Payload ID: 15184
  Gene Symbol: RSPO2
  Gene Name: R-spondin 2
  Uniprot ID: Q6UXX9
  ENSP ID: ENSP00000427937
MQFRLFSFALIILNCMDYSHCQGNRWRRSKRGCRIENCDSCFSKDFCTKCKVGFYLHRGRCFDECPDGFAPLEETMECVGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 76066 - protein, 168 aa, Homo sapiens
  Payload ID: 15184
  Gene Symbol: RSPO2
  Gene Name: R-spondin 2
  ENSP ID: ENSP00000428614
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVF

SEQ ID NO: 76067 - protein, 176 aa, Homo sapiens
  Payload ID: 15184
  Gene Symbol: RSPO2
  Gene Name: R-spondin 2
  Uniprot ID: Q6UXX9
  ENSP ID: ENSP00000428940
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 76068 - protein, 89 aa, Homo sapiens
  Payload ID: 15184
  Gene Symbol: RSPO2
  Gene Name: R-spondin 2
  ENSP ID: ENSP00000429159
MDLASYVSNPICKGCLSCSKDNGCSRCQQKLFFFLRREGMRQYGECLHSCPSGYYGHRAPDMNRCARCRIENCDSCFSKDFCTKCKVGF

SEQ ID NO: 76069 - protein, 121 aa, Homo sapiens
  Payload ID: 15184
  Gene Symbol: RSPO2
  Gene Name: R-spondin 2
  ENSP ID: ENSP00000430010
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHR

SEQ ID NO: 76070 - protein, 89 aa, Homo sapiens
  Payload ID: 15184
  Gene Symbol: RSPO2
  Gene Name: R-spondin 2
  ENSP ID: ENSP00000430485
MRQYGECLHSCPSGYYGHRAPDMNRCARCRIENCDSCFSKDFCTKCKVGFYLHRGRCFDECPDGFAPLEETMECVEGCEVGHWSEWGTC

SEQ ID NO: 76071 - protein, 76 aa, Homo sapiens
  Payload ID: 15184
  Gene Symbol: RSPO2
  Gene Name: R-spondin 2
  ENSP ID: ENSP00000430973
MQFRLFSFALIILNCMDYSHCQGNRWRRSKRASYVSNPICKGCLSCSKDNGCSRCQQKLFFFLRREGMRQYGECLH

SEQ ID NO: 76072 - protein, 272 aa, Homo sapiens
  Payload ID: 15185
  Gene Symbol: RSPO3
  Gene Name: R-spondin 3
  Uniprot ID: Q9BXY4
  ENSP ID: ENSP00000349131
MHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSVSVSTVH

SEQ ID NO: 76073 - protein, 292 aa, Homo sapiens
  Payload ID: 15185
  Gene Symbol: RSPO3
  Gene Name: R-spondin 3
  Uniprot ID: Q9BXY4
  ENSP ID: ENSP00000357300
MHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSGIEVTLAEGLTSVSQRTQPTPCRRRYL

SEQ ID NO: 76074 - protein, 234 aa, Homo sapiens
  Payload ID: 15186
  Gene Symbol: RSPO4
  Gene Name: R-spondin 4
  Uniprot ID: Q2I0M5
  ENSP ID: ENSP00000217260
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQGECELGPWGGWSPCTHNGKTCGSAWGLESRVREAGRAGHEEAATCQVLSESRKCPIQRPCPGERSPGQKKGRKDRRPRKDRKLDRRLDVRPRQPGLQP

SEQ ID NO: 76075 - protein, 172 aa, Homo sapiens
  Payload ID: 15186
  Gene Symbol: RSPO4
  Gene Name: R-spondin 4
  Uniprot ID: Q2I0M5
  ENSP ID: ENSP00000383475
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQERSPGQKKGRKDRRPRKDRKLDRRLDVRPRQPGLQP

SEQ ID NO: 76076 - protein, 785 aa, Homo sapiens
  Payload ID: 15187
  Gene Symbol: RTEL1-TNFRSF6B
  Gene Name: RTEL1-TNFRSF6B readthrough (NMD candidate)
  ENSP ID: ENSP00000457428
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKSKCCPPRLLAAGWGLLLARRWVTPPRPTVILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRCQRRPPGLQHPVCVEKMLSARPSRLAPSSPPGKLRVWTCMSPA

SEQ ID NO: 76077 - protein, 1400 aa, Homo sapiens
  Payload ID: 15187
  Gene Symbol: RTEL1-TNFRSF6B
  Gene Name: RTEL1-TNFRSF6B readthrough (NMD candidate)
  ENSP ID: ENSP00000457868
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPHKDHEGAGGARPVAAVPGVGAACPAAGAGCTRSGRNTHLPLAGRRDRGAAGVRPVPPRHLCAAAVPPRQPHDVWPVSTAPLHAVLELPRALPLLQRPLRGA

SEQ ID NO: 76078 - protein, 710 aa, Homo sapiens
  Payload ID: 15188
  Gene Symbol: RTF1
  Gene Name: RTF1 homolog, Paf1/RNA polymerase II complex component
  Uniprot ID: Q92541
  ENSP ID: ENSP00000374280
MRGRLCVGRAAAAAAAVAVPLAGGQEGSPGGGRRGSRGTTMVKKRKGRVVIDSDTEDSGSDENLDQELLSLAKRKRSDSEEKEPPVSQPAASSDSETSDSDDEWTFGSNKNKKKGKARKIEKKGTMKKQANKTASSGSSDKDSSAESSAPEEGEVSDSDSNSSSSSSDSDSSSEDEEFHDGYGEDLMGDEEDRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 76079 - protein, 171 aa, Homo sapiens
  Payload ID: 15188
  Gene Symbol: RTF1
  Gene Name: RTF1 homolog, Paf1/RNA polymerase II complex component
  ENSP ID: ENSP00000452973
  MOD_RES (1)..(1): Any amino acid
XGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVVRKLYLNH

SEQ ID NO: 76080 - protein, 708 aa, Homo sapiens
  Payload ID: 15189
  Gene Symbol: RUFY1
  Gene Name: RUN and FYVE domain containing 1
  Uniprot ID: Q96T51
  ENSP ID: ENSP00000325594
MADREGGCAAGRGRELEPELEPGPGPGSALEPGEEFEIVDRSQLPGPGDLRSATRPRAAEGWSAPILTLARRATGNLSASCGSALRAAAGLGGGDSGDGTARAASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 76081 - protein, 600 aa, Homo sapiens
  Payload ID: 15189
  Gene Symbol: RUFY1
  Gene Name: RUN and FYVE domain containing 1
  Uniprot ID: Q96T51
  ENSP ID: ENSP00000377087
MMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 76082 - protein, 324 aa, Homo sapiens
  Payload ID: 15189
  Gene Symbol: RUFY1
  Gene Name: RUN and FYVE domain containing 1
  ENSP ID: ENSP00000377094
  MOD_RES (1)..(1): Any amino acid
XGLGGGDSGDGTARAASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEEEERMKGQDKGGLSRGRELAASCPAVSLLDTSCLLLAGGGCSALLRLSTAFSCNRPNLLTSRRTAAVKRTK

SEQ ID NO: 76083 - protein, 600 aa, Homo sapiens; identical to SEQ ID NO: 76081
  Payload ID: 15189
  Gene Symbol: RUFY1
  Gene Name: RUN and FYVE domain containing 1
  Uniprot ID: Q96T51
  ENSP ID: ENSP00000390025

SEQ ID NO: 76084 - protein, 219 aa, Homo sapiens
  Payload ID: 15189
  Gene Symbol: RUFY1
  Gene Name: RUN and FYVE domain containing 1
  ENSP ID: ENSP00000425533
  MOD_RES (1)..(1): Any amino acid
XLGGGDSGDGTARAAGVLLVTQAGVQWRDLGSRQPPPPRFKRFSCLSLPSSWDYKHAPPRPASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNV

SEQ ID NO: 76085 - protein, 328 aa, Homo sapiens
  Payload ID: 15189
  Gene Symbol: RUFY1
  Gene Name: RUN and FYVE domain containing 1
  ENSP ID: ENSP00000426117
  MOD_RES (1)..(1): Any amino acid
XQDLDGGKEHERITDVLDQKNYVEELNRHLSCTVGDLQTKIDGLEKTNSKLQEEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQ

SEQ ID NO: 76086 - protein, 271 aa, Homo sapiens
  Payload ID: 15189
  Gene Symbol: RUFY1
  Gene Name: RUN and FYVE domain containing 1
  ENSP ID: ENSP00000426701
  MOD_RES (1)..(1): Any amino acid
XATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKDCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNE

SEQ ID NO: 76087 - protein, 196 aa, Homo sapiens
  Payload ID: 15190
  Gene Symbol: RUFY2
  Gene Name: RUN and FYVE domain containing 2
  ENSP ID: ENSP00000265865
MEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 76088 - protein, 232 aa, Homo sapiens
  Payload ID: 15190
  Gene Symbol: RUFY2
  Gene Name: RUN and FYVE domain containing 2
  ENSP ID: ENSP00000341727
MATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERYDFHKLFHILGFLYSSLQIIIRSIYLQCGFILLFSPL

SEQ ID NO: 76089 - protein, 641 aa, Homo sapiens
  Payload ID: 15190
  Gene Symbol: RUFY2
  Gene Name: RUN and FYVE domain containing 2
  Uniprot ID: Q8WXA3
  ENSP ID: ENSP00000373420
MTFQVWGWRREDASQVLAWVPDAEGGRRGMLTRRSLATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 76090 - protein, 403 aa, Homo sapiens
  Payload ID: 15190
  Gene Symbol: RUFY2
  Gene Name: RUN and FYVE domain containing 2
  Uniprot ID: Q8WXA3
  ENSP ID: ENSP00000382151
MATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLNEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQSDNDLLTQTRTIAMSLVKCASSDTQDQYKLVKDISF

SEQ ID NO: 76091 - protein, 379 aa, Homo sapiens
  Payload ID: 15190
  Gene Symbol: RUFY2
  Gene Name: RUN and FYVE domain containing 2
  Uniprot ID: Q8WXA3
  ENSP ID: ENSP00000404986
MVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQSDNDLLTQTRTIAMSLVKCASSDTQDQYKLVKDISF

SEQ ID NO: 76092 - protein, 620 aa, Homo sapiens
  Payload ID: 15190
  Gene Symbol: RUFY2
  Gene Name: RUN and FYVE domain containing 2
  ENSP ID: ENSP00000433197
  MOD_RES (1)..(1): Any amino acid
XGLEVPRRPGARTGPATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 76093 - protein, 606 aa, Homo sapiens
  Payload ID: 15190
  Gene Symbol: RUFY2
  Gene Name: RUN and FYVE domain containing 2
  Uniprot ID: Q8WXA3
  ENSP ID: ENSP00000473462
MATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 76094 - protein, 130 aa, Homo sapiens
  Payload ID: 15190
  Gene Symbol: RUFY2
  Gene Name: RUN and FYVE domain containing 2
  ENSP ID: ENSP00000474574
  MOD_RES (1)..(1): Any amino acid
XSHLRNETQQIISLKKEFLNLQDENQQLKKIYHEQEQALQELGNKLSESKLKIEDIKEANKALQGLVWLKDKEATHCKLCEKEFSLSKRKTWQLLHLHVSQTLHLLLLWLCHQLQYQYELVLDLVVRRTK

SEQ ID NO: 76095 - protein, 469 aa, Homo sapiens
  Payload ID: 15191
  Gene Symbol: RUFY3
  Gene Name: RUN and FYVE domain containing 3
  Uniprot ID: Q7L099
  ENSP ID: ENSP00000226328
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQSEKDLVKQAKTLNSAANKLIPKHH

SEQ ID NO: 76096 - protein, 620 aa, Homo sapiens
  Payload ID: 15191
  Gene Symbol: RUFY3
  Gene Name: RUN and FYVE domain containing 3
  Uniprot ID: Q7L099
  ENSP ID: ENSP00000370394
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQRLRQAERSRQSAELDNRLFKQDFGDKINSLQLEVEELTRQRNQLELELKQEKERRLQNDRSIPGRGSQKSESKMDGKHKMQEENVKLKKPLEESHRLQPHPMDEQDQLLLSEKPQLCQLCQEDGSLTKNVCKNCSGTFCDACSTNELPLPSSIKLERVCNPCHKHLMKQYSTSPS

SEQ ID NO: 76097 - protein, 506 aa, Homo sapiens
  Payload ID: 15191
  Gene Symbol: RUFY3
  Gene Name: RUN and FYVE domain containing 3
  Uniprot ID: Q7L099
  ENSP ID: ENSP00000399771
MAETPPPPTAGAESCSEEPARGGEWRPEEPRRAPAGGTDREGEAGPPPASPAGQSEPDSPVAAPFFLLYPGDGGAGFGVRPPPQQQRSWRTPPSPGSPLPFLLLSYPSGGGGSSGSGKHHPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQR

SEQ ID NO: 76098 - protein, 57 aa, Homo sapiens
  Payload ID: 15191
  Gene Symbol: RUFY3
  Gene Name: RUN and FYVE domain containing 3
  ENSP ID: ENSP00000420980
  MOD_RES (1)..(1): Any amino acid
XALKHELAFKLQSSDLGVKQKSELNSRLEEKTNQMAATIKQLEQRMGSTKCKRKMLN

SEQ ID NO: 76099 - protein, 145 aa, Homo sapiens
  Payload ID: 15191
  Gene Symbol: RUFY3
  Gene Name: RUN and FYVE domain containing 3
  ENSP ID: ENSP00000421120
  MOD_RES (1)..(1): Any amino acid
XQLRLDVEKELEMQISMRQEMELAMKMLEKDVCEKQDALVSLRQQLDDLRALKHELAFKLQSSDLGVKQKSELNSRLEEKTNQMAATIKQLEQSSCGSHPDCARLSEAANLLSWTTGSSNRTLETRSTVCSWKSRSSPGSGTSLS

SEQ ID NO: 76100 - protein, 567 aa, Homo sapiens
  Payload ID: 15191
  Gene Symbol: RUFY3
  Gene Name: RUN and FYVE domain containing 3
  Uniprot ID: Q7L099
  ENSP ID: ENSP00000425400
MRDDTEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQRLRQAERSRQSAELDNRLFKQDFGDKINSLQLEVEELTRQRNQLELELKQEKERRLQNDRSIPGRGSQKSESKMDGKHKMQEENVKLKKPLEESHRLQPHPMDEQDQLLLSEKPQLCQLCQEDGSLTKNVCKNCSGTFCDACSTNELPLPSSIKLERVCNPCHKHLMKQYSTSPS

SEQ ID NO: 76101 - protein, 201 aa, Homo sapiens
  Payload ID: 15191
  Gene Symbol: RUFY3
  Gene Name: RUN and FYVE domain containing 3
  ENSP ID: ENSP00000425574
MANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKN

SEQ ID NO: 76102 - protein, 98 aa, Homo sapiens
  Payload ID: 15191
  Gene Symbol: RUFY3
  Gene Name: RUN and FYVE domain containing 3
  ENSP ID: ENSP00000426165
MAETPPPPTAGAESCSEEPARGGEWRPEEPRRAPAGGTDREGEAGPPPASPAGQSEPDSPVAAPFFLLYPGDGGAGFGVRPPPQQQRSWRTPPSPGSP

SEQ ID NO: 76103 - protein, 155 aa, Homo sapiens
  Payload ID: 15191
  Gene Symbol: RUFY3
  Gene Name: RUN and FYVE domain containing 3
  ENSP ID: ENSP00000426734
MANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVID

SEQ ID NO: 76104 - protein, 571 aa, Homo sapiens
  Payload ID: 15192
  Gene Symbol: RUFY4
  Gene Name: RUN and FYVE domain containing 4
  Uniprot ID: Q6ZNE9
  ENSP ID: ENSP00000345900
MAEEGAILKVTKDLRAAVSAILQGYGDGQGPVTDTSAELHRLCGCLELLLQFDQKEQKSFLGPRKDYWDFLCTALRRQRGNMEPIHFVRSQDKLKTPLGKGRAFIRFCLARGQLAEALQLCLLNSELTREWYGPRSPLLCPERQEDILDSLYALNGVAFELDLQQPDLDGAWPMFSESRCSSSTQTQGRRPRKNKDAPKKIPAAYGGPENVQIEDSHTSQAICLQDAPSGQQLAGLPRSQQQRHLPFFLEKKGESSRKHRYPQSMWEPEGKELQLDQEERAPWIEIFLGNSTPSTQGQGKGAMGTQKEVIGMEAEVTGVLLVAEGQRTTEGTHKKEAEWSHVQRLLMPSPRGAVEGAVSGSRQGSGGSSILGEPWVLQGHATKEDSTVENPQVQTEVTLVARREEQAEVSLQDEIKSLRLGLRKAEEQAQRQEQLLREQEGELQALREQLSRCQEERAELQAQLEQKQQEAERRDAMYQEELGGQRDLVQAMKRRVLELIQEKDRLWQRLQHLSSMAPECCVACSKIFGRFSRRYPCRLCGGLLCHACSMDYKKRDRCCPPCAQGREAQVT

SEQ ID NO: 76105 - protein, 607 aa, Homo sapiens
  Payload ID: 15192
  Gene Symbol: RUFY4
  Gene Name: RUN and FYVE domain containing 4
  ENSP ID: ENSP00000363270
MAEEGAILKVTKDLRAAVSAILQGYGDGQGPVTDTSAELHRLCGCLELLLQFDQKEQKSFLGPRKDYWDFLCTALRRQRGNMEPIHFVRSQDKLKTPLGKGRAFIRFCLARGQLAEALQLCLLNSELTREWYGPRSPLLCPERQEDILDSLYALNGVAFELDLQQPDLDGAWPMFSESRCSSSTQTQGRRPRKNKDAPKKVPLPCLHSELPLPHLLGILKIPAAYGGPENVQIEDSHTSQAICLQDAPSGQQLAGLPRSQQQRHLPFFLEKKGESSRKHRYPQSMWEPEGKELQLDQEERAPWIEIFLGNSTPSTQGQGKGAMGTQKEVIGMEAEVTGVLLVAEGQRTTEGTHKKEAEWSHVQRLLMPSPRGAVEGAVSGSRQGSGGSSILGEPWVLQGHATKEDSTVENPQVQTEVTLVARREEQAEVSLQDEIKSLRLGLRKAEEQAQRQEQLLREQEGELQALREQLSRCQEERAELQAQLEQKQQEAERRDAMYQEELGGQRDLVQAMKRRVLELIQEKDRLWQRLQHLSSMAPECCVACSKIFGRFSRRYPCSARTSLGREESEPPGEAAMWRWRLWRGRASGHPSGEGRPPETNQGHSTGR

SEQ ID NO: 76106 - protein, 172 aa, Homo sapiens
  Payload ID: 15192
  Gene Symbol: RUFY4
  Gene Name: RUN and FYVE domain containing 4
  Uniprot ID: Q6ZNE9
  ENSP ID: ENSP00000410091
MAEEGAILKVTKDLRAAVSAILQGYGDGQGPVTDTSAELHRLCGCLELLLQFDQKEQKSFLGPRKDYWDFLCTALRRQRGNMEPIHFVRSQDKGMVWTPEPSALPRTPRRHPGLSLCSQWGGLRVGPPAARPGWSLAHVLRVTLLQFHPNPGKETQKKQRCPKEDPSRIWRA

SEQ ID NO: 76107 - protein, 433 aa, Homo sapiens
  Payload ID: 15193
  Gene Symbol: RUSC1
  Gene Name: RUN and SH3 domain containing 1
  Uniprot ID: Q9BVN2
  ENSP ID: ENSP00000292254
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 76108 - protein, 492 aa, Homo sapiens
  Payload ID: 15193
  Gene Symbol: RUSC1
  Gene Name: RUN and SH3 domain containing 1
  Uniprot ID: Q9BVN2
  ENSP ID: ENSP00000357331
MPPTCSPGLRRQDWAPGRCAGLHLPPRAPSSPALQALAGQAGVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 76109 - protein, 433 aa, Homo sapiens; identical to SEQ ID NO: 76107
  Payload ID: 15193
  Gene Symbol: RUSC1
  Gene Name: RUN and SH3 domain containing 1
  Uniprot ID: Q9BVN2
  ENSP ID: ENSP00000357333

SEQ ID NO: 76110 - protein, 902 aa, Homo sapiens
  Payload ID: 15193
  Gene Symbol: RUSC1
  Gene Name: RUN and SH3 domain containing 1
  Uniprot ID: Q9BVN2
  ENSP ID: ENSP00000357336
MLSPQRALLCNLNHIHLQHVSLGLHLSRRPELQEGPLSTPPPPGDTGGKESRGPCSGTLVDANSNSPAVPCRCCQEHGPGLENRQDPSQEEEGAASPSDPGCSSSLSSCSDLSPDESPVSVYLRDLPGDEDAHPQPSIIPLEQGSPLASAGPGTCSPDSFCCSPDSCSGASSSPDPGLDSNCNALTTCQDVPSPGLEEEDERAEQDLPTSELLEADDGKIDAGKTEPSWKINPIWKIDTEKTKAEWKTTENNNTGWKNNGNVNSSWKSEPEKFDSGWKTNTRITDSGSKTDAGKIDGGWRSDVSEEPVPHRTITSFHELAQKRKRGPGLPLVPQAKKDRSDWLIVFSPDTELPPSGSPGGSSAPPREVTTFKELRSRSRAPAPPVPPRDPPVGWALVPPRPPPPPVPPRRKKNRPGLQPIAEGQSEEGRAVSPAAGEEAPAAKEPGAQAGLEVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 76111 - protein, 796 aa, Homo sapiens
  Payload ID: 15193
  Gene Symbol: RUSC1
  Gene Name: RUN and SH3 domain containing 1
  Uniprot ID: Q9BVN2
  ENSP ID: ENSP00000357338
MLSPQRALLCNLNHIHLQHVSLGLHLSRRPELQEGPLSTPPPPGDTGGKESRGPCSGTLVDANSNSPAVPCRCCQEHGPGLENRQDPSQEEEGAASPSDPGCSSSLSSCSDLSPDESPVSVYLRDLPGDEDAHPQPSIIPLEQGSPLASAGPGTCSPDSFCCSPDSCSGASSSPDPGLDSNCNALTTCQDVPSPGLEEEDERAEQDLPTSELLEADDGKIDAGKTEPSWKINPIWKIDTEKTKAEWKTTENNNTGWKNNGNVNSSWKSEPEKFDSGWKTNTRITDSGSKTDAGKIDGGWRSDVSEEPVPHRTITSFHELAQKRKRGPGLPLVPQAKKDRSDWLIVFSPDTELPPSGSPGGSSAPPREVTTFKELRSRSRAPAPPVPPRDPPVGWALVPPRPPPPPVPPRRKKNRPGLQPIAEGQSEEGRAVSPAAGEEAPAAKEPGAQAGLEVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 76112 - protein, 265 aa, Homo sapiens
  Payload ID: 15193
  Gene Symbol: RUSC1
  Gene Name: RUN and SH3 domain containing 1
  ENSP ID: ENSP00000479495
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLT

SEQ ID NO: 76113 - protein, 301 aa, Homo sapiens
  Payload ID: 15193
  Gene Symbol: RUSC1
  Gene Name: RUN and SH3 domain containing 1
  ENSP ID: ENSP00000479858
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERP

SEQ ID NO: 76114 - protein, 271 aa, Homo sapiens
  Payload ID: 15193
  Gene Symbol: RUSC1
  Gene Name: RUN and SH3 domain containing 1
  ENSP ID: ENSP00000480831
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTH

SEQ ID NO: 76115 - protein, 225 aa, Homo sapiens
  Payload ID: 15193
  Gene Symbol: RUSC1
  Gene Name: RUN and SH3 domain containing 1
  ENSP ID: ENSP00000481669
  MOD_RES (1)..(1): Any amino acid
XSSTRSLGTLYSQVSRLAPLSSSRSRFHAFILGLLNTKQLELWFSSLQEDAGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKS

SEQ ID NO: 76116 - protein, 105 aa, Homo sapiens
  Payload ID: 15193
  Gene Symbol: RUSC1
  Gene Name: RUN and SH3 domain containing 1
  ENSP ID: ENSP00000482109
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPARSAV

SEQ ID NO: 76117 - protein, 127 aa, Homo sapiens
  Payload ID: 15193
  Gene Symbol: RUSC1
  Gene Name: RUN and SH3 domain containing 1
  ENSP ID: ENSP00000482409
MAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 76118 - protein, 211 aa, Homo sapiens
  Payload ID: 15193
  Gene Symbol: RUSC1
  Gene Name: RUN and SH3 domain containing 1
  ENSP ID: ENSP00000484026
MQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 76119 - protein, 1516 aa, Homo sapiens
  Payload ID: 15194
  Gene Symbol: RUSC2
  Gene Name: RUN and SH3 domain containing 2
  Uniprot ID: Q8N2Y8
  ENSP ID: ENSP00000355177
MDSPPKLTGETLIVHHIPLVHCQVPDRQCCGGAGGGGGSTRPNPFCPPELGITQPDQDLGQADSLLFSSLHSTPGGTARSIDSTKSRSRDGRGPGAPKRHNPFLLQEGVGEPGLGDLYDDSIGDSATQQSFHLHGTGQPNFHLSSFQLPPSGPRVGRPWGTTRSRAGVVEGQEQEPVMTLDTQQCGTSHCCRPELEAETMELDECGGPGGSGSGGGASDTSGFSFDQEWKLSSDESPRNPGCSGSGDQHCRCSSTSSQSEAADQSMGYVSDSSCNSSDGVLVTFSTLYNKMHGTPRANLNSAPQSCSDSSFCSHSDPGAFYLDLQPSPFESKMSYESHHPESGGREGGYGCPHASSPELDANCNSYRPHCEPCPAVADLTACFQSQARLVVATQNYYKLVTCDLSSQSSPSPAGSSITSCSEEHTKISPPPGPGPDPGPSQPSEYYLFQKPEVQPEEQEAVSSSTQAAAAVGPTVLEGQVYTNTSPPNLSTGRQRSRSYDRSLQRSPPVRLGSLERMLSCPVRLSEGPAAMAGPGSPPRRVTSFAELAKGRKKTGGSGSPPLRVSVGDSSQEFSPIQEAQQDRGAPLDEGTCCSHSLPPMPLGPGMDLLGPDPSPPWSTQVCQGPHSSEMPPAGLRATGQGPLAQLMDPGPALPGSPANSHTQRDARARADGGGTESRPVLRYSKEQRPTTLPIQPFVFQHHFPKQLAKARALHSLSQLYSLSGCSRTQQPAPLAAPAAQVSVPAPSGEPQASTPRATGRGARKAGSEPETSRPSPLGSYSPIRSVGPFGPSTDSSASTSCSPPPEQPTATESLPPWSHSCPSAVRPATSQQPQKEDQKILTLTEYRLHGTGSLPPLGSWRSGLSRAESLARGGGEGSMATRPSNANHLSPQALKWREYRRKNPLGPPGLSGSLDRRSQEARLARRNPIFEFPGSLSAASHLNCRLNGQAVKPLPLTCPDFQDPFSLTEKPPAEFCLSPDGSSEAISIDLLQKKGLVKAVNIAVDLIVAHFGTSRDPGVKAKLGNSSVSPNVGHLVLKYLCPAVRAVLEDGLKAFVLDVIIGQRKNMPWSVVEASTQLGPSTKVLHGLYNKVSQFPELTSHTMRFNAFILGLLNIRSLEFWFNHLYNHEDIIQTHYQPWGFLSAAHTVCPGLFEELLLLLQPLALLPFSLDLLFQHRLLQSGQQQRQHKELLRVSQDLLLSAHSTLQLARARGQEGPGDVDRAAQGERVKGVGASEGGEEEEEEEETEEVAEAAGGSGRARWARGGQAGWWYQLMQSSQVYIDGSIEGSRFPRGSSNSSSEKKKGAGGGGPPQAPPPREGVVEGAEACPASEEALGRERGWPFWMGSPPDSVLAELRRSREREGPAASPAENEEGASEPSPGGIKWGHLFGSRKAQREARPTNRLPSDWLSLDKSMFQLVAQTVGSRREPEPKESLQEPHSPALPSSPPCEVQALCHHLATGPGQLSFHKGDILRVLGRAGGDWLRCSRGPDSGLVPLAYVTLTPTPSPTPGSSQN

SEQ ID NO: 76120 - protein, 1516 aa, Homo sapiens; identical to SEQ ID NO: 76119
  Payload ID: 15194
  Gene Symbol: RUSC2
  Gene Name: RUN and SH3 domain containing 2
  Uniprot ID: Q8N2Y8
  ENSP ID: ENSP00000393922

SEQ ID NO: 76121 - protein, 927 aa, Homo sapiens
  Payload ID: 15195
  Gene Symbol: RUBCN
  Gene Name: RUN domain and cysteine-rich domain containing, Beclin 1-interacting protein
  Uniprot ID: Q92622
  ENSP ID: ENSP00000273582
MQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPGGPRNITIIVEDPIAESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMLCQAKGFICEFCQNEDDIIFPFELHKCRTCEECKACYHKACFKSGSCPRCERLQARREALARQSLESYLSDYEEEPAEALALEAAVLEAT

SEQ ID NO: 76122 - protein, 972 aa, Homo sapiens
  Payload ID: 15195
  Gene Symbol: RUBCN
  Gene Name: RUN domain and cysteine-rich domain containing, Beclin 1-interacting protein
  Uniprot ID: Q92622
  ENSP ID: ENSP00000296343
MRPEGAGMELGGGEERLPEESRREHWQLLGNLKTTVEGLVSTNSPNVWSKYGGLERLCRDMQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMLCQAKGFICEFCQNEDDIIFPFELHKCRTCEECKACYHKACFKSGSCPRCERLQARREALARQSLESYLSDYEEEPAEALALEAAVLEAT

SEQ ID NO: 76123 - protein, 435 aa, Homo sapiens
  Payload ID: 15195
  Gene Symbol: RUBCN
  Gene Name: RUN domain and cysteine-rich domain containing, Beclin 1-interacting protein
  ENSP ID: ENSP00000390962
MRPEGAGMELGGGEERLPEESRREHWQLLGNLKTTVEGLVSTNSPNVWSKYGGLERLCRDMQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPGNEEHRLLVSKMTLN

SEQ ID NO: 76124 - protein, 934 aa, Homo sapiens
  Payload ID: 15195
  Gene Symbol: RUBCN
  Gene Name: RUN domain and cysteine-rich domain containing, Beclin 1-interacting protein
  ENSP ID: ENSP00000405115
  MOD_RES (1)..(1): Any amino acid
XREHWQLLGNLKTTVEGLVSTNSPNVWSKYGGLERLCRDMQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPGGPRNITIIVEDPIAEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMLCQAKGFICEFCQNEDDIIFPFELHKCRTCEECKACYHKACFKSGSCPRCERLQARREALARQSLESYLSDYEEEPAEALALEAAVLEAT

SEQ ID NO: 76125 - protein, 680 aa, Homo sapiens
  Payload ID: 15195
  Gene Symbol: RUBCN
  Gene Name: RUN domain and cysteine-rich domain containing, Beclin 1-interacting protein
  ENSP ID: ENSP00000409618
  MOD_RES (1)..(1): Any amino acid
XERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDGSEGSNLTHISKNGLSVSLASMFSDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMVRKSHCSMQLSPCF

SEQ ID NO: 76126 - protein, 147 aa, Homo sapiens
  Payload ID: 15195
  Gene Symbol: RUBCN
  Gene Name: RUN domain and cysteine-rich domain containing, Beclin 1-interacting protein
  ENSP ID: ENSP00000411894
LGDQEGGGESQLSSVLRRSSFSEGQTLTVTSGAKKSHIRSHSDTSIASRGAPEGGRYLCSGEGMFRRPSEGQSLISYLSEQDFGSCADLEKENAHFSISESLIAAIELMKCNMMSQCLEEEEVEEEDSDREIQELKQKIRLRRQQIR

SEQ ID NO: 76127 - protein, 24 aa, Homo sapiens
  Payload ID: 15195
  Gene Symbol: RUBCN
  Gene Name: RUN domain and cysteine-rich domain containing, Beclin 1-interacting protein
  ENSP ID: ENSP00000485041
MLQCLEAVEQNNPRLLAQIDASMF

SEQ ID NO: 76128 - protein, 613 aa, Homo sapiens
  Payload ID: 15196
  Gene Symbol: RUNDC1
  Gene Name: RUN domain containing 1
  Uniprot ID: Q96C34
  ENSP ID: ENSP00000354622
MAAVEAAAEPVTVVAAVGPKAKDEEEEEEEPLPPCEAVRWAPVGAVAEARPGATAFLEEATAEEPGAAPGSPPDSPGRTLRRLRAERRRLDSALLALSSHFAQVQFRLRQVVRGAPAEQQRLLRELEDFAFRGCPHVLGYEGPGDPASDEGDGLPGDRPWLRGEDQSEQEKQERLETQREKQKELILQLKTQLDDLETFAYQEGSYDSLPQSVVLERQRVIIDELIKKLDMNLNEDISSLSTEELRQRVDAAVAQIVNPARVKEQLVEQLKTQIRDLEMFINFIQDEVGSPLQTGGGHCECKAGGKTGNGCSRTGSSRTPPGNSKTKAEDVKKVRETGLHLMRRALAVLQIFAVSQFGCATGQIPPTLWQRVQADRDYSPLLKRLEVSVDRVKQLALRQQPHDHVITSANLQDLSLGGKDELTMAVRKELTVAVRDLLAHGLYASSPGMSLVMAPIACLLPAFSSAPEAMHPWELFVKYYHAKNGRAYVESPARKLSQSFALPVTGGTVVTPKQSLLTAIHMVLTEHDPFKRSADSELKALVCMALNEQRLVSWVNLICKSGSLIEPHYQPWSYMAHTGFESALNLLSRLSSLKFSLPVDLAVRQLKNIKDAF

SEQ ID NO: 76129 - protein, 263 aa, Homo sapiens
  Payload ID: 15196
  Gene Symbol: RUNDC1
  Gene Name: RUN domain containing 1
  ENSP ID: ENSP00000467953
  MOD_RES (1)..(1): Any amino acid
XAVEAAAEPVTVVAAVGPKAKDEEEEEEEPLPPCEAVRWAPVGAVAEARPGATAFLEEATAEEPGAAPGSPPDSPGRTLRRLRAERRRLDSALLALSSHFAQVQFRLRQVVRGAPAEQQRLLRELEDFAFRGCPHVLGYEGPGDPASDEGDGLPGDRPWLRGEDQSEQEKQERLETQREKQKELILQLKTQLDDLETFAYQEGSYDSLPQSVVLERQRMKWEAPCRQVVDTVSARPVGRQEMAAAEQAAAERLQETAKQRQRM

SEQ ID NO: 76130 - protein, 405 aa, Homo sapiens
  Payload ID: 15197
  Gene Symbol: RUNDC3A
  Gene Name: RUN domain containing 3A
  Uniprot ID: Q59EK9
  ENSP ID: ENSP00000225441
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGSSEPN

SEQ ID NO: 76131 - protein, 446 aa, Homo sapiens
  Payload ID: 15197
  Gene Symbol: RUNDC3A
  Gene Name: RUN domain containing 3A
  Uniprot ID: Q59EK9
  ENSP ID: ENSP00000410862
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGKDPTPSMLGLCGSLASIPSCKSLASFKSNECLVSDSPEGSPALSPS

SEQ ID NO: 76132 - protein, 400 aa, Homo sapiens
  Payload ID: 15197
  Gene Symbol: RUNDC3A
  Gene Name: RUN domain containing 3A
  Uniprot ID: Q59EK9
  ENSP ID: ENSP00000468214
MEASFVQTTMALGLSSKKASSRNVAVERKNLITVCRFSVKTLLEKYTAEPIDDSSEEFVNFAAILEQILSHRFKGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGSSEPN

SEQ ID NO: 76133 - protein, 404 aa, Homo sapiens
  Payload ID: 15197
  Gene Symbol: RUNDC3A
  Gene Name: RUN domain containing 3A
  ENSP ID: ENSP00000483684
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGSSPN

SEQ ID NO: 76134 - protein, 473 aa, Homo sapiens
  Payload ID: 15198
  Gene Symbol: RUNDC3B
  Gene Name: RUN domain containing 3B
  Uniprot ID: Q96NL0
  ENSP ID: ENSP00000337732
MASRSLGGLSGIRGGGGGGGKKSLSARNAAVERRNLITVCRFSVKTLIDRSCFETIDDSSPEFNNFAAILEQILSHRLKEISQSCRWLAHLQIPLQGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQLTVLKNNDLRSRQELTAHLTNQWPSPGALDVNAVALDTLLYRKHNKQWYEKSYQSLDQLSAEVSLSQTSLDPGQSQEGDGKQDTLNVMSEGKEDTPSLLGLCGSLTSVASYKSLTSLKSNDYLASPTTEMTSPGLTPS

SEQ ID NO: 76135 - protein, 456 aa, Homo sapiens
  Payload ID: 15198
  Gene Symbol: RUNDC3B
  Gene Name: RUN domain containing 3B
  Uniprot ID: Q96NL0
  ENSP ID: ENSP00000378149
MASRSLGGLSGIRGGGGGGGKKSLSARNAAVERRNLITVCRFSVKTLIDRSCFETIDDSSPEFNNFAAILEQILSHRLKGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQLTVLKNNDLRSRQELTAHLTNQWPSPGALDVNAVALDTLLYRKHNKQWYEKSYQSLDQLSAEVSLSQTSLDPGQSQEGDGKQDTLNVMSEGKEDTPSLLGLCGSLTSVASYKSLTSLKSNDYLASPTTEMTSPGLTPS

SEQ ID NO: 76136 - protein, 407 aa, Homo sapiens
  Payload ID: 15198
  Gene Symbol: RUNDC3B
  Gene Name: RUN domain containing 3B
  Uniprot ID: Q96NL0
  ENSP ID: ENSP00000420394
MASRSLGGLSGIRGGGGGGGKKSLSARNAAVERRNLITVCRFSVKTLIDRSCFETIDDSSPEFNNFAAILEQILSHRLKGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQLKSYQSLDQLSAEVSLSQTSLDPGQSQEGDGKQDTLNVMSEGKEDTPSLLGLCGSLTSVASYKSLTSLKSNDYLASPTTEMTSPGLTPS

SEQ ID NO: 76137 - protein, 480 aa, Homo sapiens
  Payload ID: 15199
  Gene Symbol: RUNX1
  Gene Name: runt-related transcription factor 1
  Uniprot ID: Q01196
  ENSP ID: ENSP00000300305
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 76138 - protein, 453 aa, Homo sapiens
  Payload ID: 15199
  Gene Symbol: RUNX1
  Gene Name: runt-related transcription factor 1
  Uniprot ID: Q01196
  ENSP ID: ENSP00000340690
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 76139 - protein, 250 aa, Homo sapiens
  Payload ID: 15199
  Gene Symbol: RUNX1
  Gene Name: runt-related transcription factor 1
  Uniprot ID: Q01196
  ENSP ID: ENSP00000351123
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQEEDTAPWRC

SEQ ID NO: 76140 - protein, 256 aa, Homo sapiens
  Payload ID: 15199
  Gene Symbol: RUNX1
  Gene Name: runt-related transcription factor 1
  ENSP ID: ENSP00000382182
MPAAPRGPAQGEAAARTRSRDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQ

SEQ ID NO: 76141 - protein, 389 aa, Homo sapiens
  Payload ID: 15199
  Gene Symbol: RUNX1
  Gene Name: runt-related transcription factor 1
  ENSP ID: ENSP00000382184
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 76142 - protein, 140 aa, Homo sapiens
  Payload ID: 15199
  Gene Symbol: RUNX1
  Gene Name: runt-related transcription factor 1
  ENSP ID: ENSP00000388189
MASDSIFESFPSYPQCFMRDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKN

SEQ ID NO: 76143 - protein, 32 aa, Homo sapiens
  Payload ID: 15199
  Gene Symbol: RUNX1
  Gene Name: runt-related transcription factor 1
  ENSP ID: ENSP00000405158
MASDSIFESFPSYPQCFMRECILGMNPSRDVH

SEQ ID NO: 76144 - protein, 480 aa, Homo sapiens; identical to SEQ ID NO: 76137
  Payload ID: 15199
  Gene Symbol: RUNX1
  Gene Name: runt-related transcription factor 1
  Uniprot ID: Q01196
  ENSP ID: ENSP00000409227

SEQ ID NO: 76145 - protein, 38 aa, Homo sapiens
  Payload ID: 15199
  Gene Symbol: RUNX1
  Gene Name: runt-related transcription factor 1
  ENSP ID: ENSP00000477067
MASDSIFESFPSYPQCFMRGGGPRGCSRWHSGHCDGWQ

SEQ ID NO: 76146 - protein, 49 aa, Homo sapiens
  Payload ID: 15199
  Gene Symbol: RUNX1
  Gene Name: runt-related transcription factor 1
  ENSP ID: ENSP00000477072
MASDSIFESFPSYPQCFMRECILGMNPSRDVHDASTSRRFTPPSTALSP

SEQ ID NO: 76147 - protein, 604 aa, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000265814
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 76148 - protein, 567 aa, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000353504
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 76149 - protein, 577 aa, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000379520
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 76150 - protein, 567 aa, Homo sapiens; identical to SEQ ID NO: 76148
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000390137

SEQ ID NO: 76151 - protein, 663 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000402257
MCHPDKAFTSDKLQCVFNEYKAAVWVPPRPRPLSRAPLPEAGGENLHLKISRVRKRNLPFVVWGEEEASTPGLDAISHHLCYPDRTHRDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 76152 - protein, 171 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000427763
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPA

SEQ ID NO: 76153 - protein, 91 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000428100
MPDSPVDVKTQSRLTPPTMPPPPTTQGAPRTSSFTPTTLTNGTSHSPTALNGAPSPPNGFSNGPSSSSSSSLANQQLPPACGARQLSKLKR

SEQ ID NO: 76154 - protein, 58 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000428133
MISVKRNTWRALSLVIGDCRKKGNFEYCQGARAQHPASGDAAPAPLMALLSAATHSRT

SEQ ID NO: 76155 - protein, 79 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000428475
MPDRTEKHSTMPDSPVDVKTQSRLTPPTMPPPPTTQGAPRTSSFTPTTLTNGTSHSPTALNGAPSPPNGFSNGPSSSSS

SEQ ID NO: 76156 - protein, 604 aa, Homo sapiens; identical to SEQ ID NO: 76147
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000428543

SEQ ID NO: 76157 - protein, 615 aa, Homo sapiens
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000428742
MCHPDKAFTSDKLQCVFNEYKAAVWVPPRPRPLSRAPLPEDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 76158 - protein, 68 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429034
MISVKRNTWRALSLVIGDCRKKGNFEYCQGARAQHPASGDAAPAPLMALLSAATHSRTGGMSPERACF

SEQ ID NO: 76159 - protein, 69 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429062
MPDRTEKHSTMPDSPVDVKTQSRLTPPTMPPPPTTQGAPRTSSFTPTTLTNGTSHSPTALNGAPSPPNG

SEQ ID NO: 76160 - protein, 30 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429085
  MOD_RES (1)..(1): Any amino acid
XLLRAASRCERKREEANSRQMNKLRSREVK

SEQ ID NO: 76161 - protein, 119 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429118
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACG

SEQ ID NO: 76162 - protein, 88 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429137
MPDSPVDVKTQSRLTPPTMPPPPTTQGAPRTSSFTPTTLTNGTSHSPTALNGAPSPPNGFSNGPSSSSSSSLANQQLPPACGARQLSK

SEQ ID NO: 76163 - protein, 85 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429375
MISVKRNTWRALSLVIGDCRKKGNFEYCQDRTEKHSTMPDSPVDVKTQSRLTPPTMPPPPTTQGAPRTSSFTPTTLTNGTSHSPT

SEQ ID NO: 76164 - protein, 135 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429506
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQ

SEQ ID NO: 76165 - protein, 156 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429532
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLV

SEQ ID NO: 76166 - protein, 36 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429587
MISVKRNTWRALSLVIGDCRKKGNFEYCQDKPHLKN

SEQ ID NO: 76167 - protein, 36 aa, Homo sapiens; identical to SEQ ID NO: 76166
  Payload ID: 15200
  Gene Symbol: RUNX1T1
  Gene Name: runt-related transcription factor 1
  translocated to, 1 (cyclin D-related)
  ENSP ID: ENSP00000429653

SEQ ID NO: 76168 - protein, 93 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429666
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSP

SEQ ID NO: 76169 - protein, 210 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429728
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDR

SEQ ID NO: 76170 - protein, 48 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429857
MISVKRNTWRALSLVIGDCRKKGNFEYCQDRTEKHSTMPDSPVDVKTQ

SEQ ID NO: 76171 - protein, 46 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429864
MPDSPVDVKTQSRLTPPTMPPPPTTQGAPRTSSFTPTTLTNGTSHS

SEQ ID NO: 76172 - protein, 120 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000429940
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVN

SEQ ID NO: 76173 - protein, 120 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000430070
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGA

SEQ ID NO: 76174 - protein, 54 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000430080
MISVKRNTWRALSLVIGDCRKKGNFEYCQDRTEKHSTMPDSPVDVKTQSRLTPP

SEQ ID NO: 76175 - protein, 36 aa, Homo sapiens; identical to SEQ ID NO: 76166
  Payload ID: 15200
  Gene Symbol: RUNX1T1
  Gene Name: runt-related transcription factor 1
  translocated to, 1 (cyclin D-related)
  ENSP ID: ENSP00000430084

SEQ ID NO: 76176 - protein, 169 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000430204
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKL

SEQ ID NO: 76177 - protein, 26 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000430334
MPDRTEKHSTMPDSPVDVKTQSRLTP

SEQ ID NO: 76178 - protein, 101 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000430637
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKR

SEQ ID NO: 76179 - protein, 577 aa, Homo sapiens; identical to SEQ ID NO: 76149
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000430728

SEQ ID NO: 76180 - protein, 127 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000430778
  MOD_RES (1)..(1): Any amino acid
XLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALG

SEQ ID NO: 76181 - protein, 31 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000430863
ASRCERKREEANSRQLFSHQLFPSISYLNVL

SEQ ID NO: 76182 - protein, 229 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000431094
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDS

SEQ ID NO: 76183 - protein, 577 aa, Homo sapiens; identical to SEQ ID NO: 76149
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000478331

SEQ ID NO: 76184 - protein, 584 aa, Homo sapiens
  Payload ID: 15200
  Gene Symbol: RUNX1T1
  Gene Name: runt-related transcription factor 1
  translocated to, 1 (cyclin D-related)
  ENSP ID: ENSP00000480500
MVGLSGPVQYRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 76185 - protein, 604 aa, Homo sapiens; identical to SEQ ID NO: 76147
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000481112

SEQ ID NO: 76186 - protein, 604 aa, Homo sapiens; identical to SEQ ID NO: 76147
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000481315

SEQ ID NO: 76187 - protein, 604 aa, Homo sapiens; identical to SEQ ID NO: 76147
  Payload ID: 15200
  Gene Symbol: RUNX1T1
  Gene Name: runt-related transcription factor 1
  translocated to, 1 (cyclin D-related)
  Uniprot ID: Q06455
  ENSP ID: ENSP00000481799

SEQ ID NO: 76188 - protein, 507 aa, Homo sapiens
  Payload ID: 15201
  Gene Symbol: RUNX2
  Gene Name: runt-related transcription factor 2
  Uniprot ID: Q13950
  ENSP ID: ENSP00000352514
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 76189 - protein, 499 aa, Homo sapiens
  Payload ID: 15201
  Gene Symbol: RUNX2
  Gene Name: runt-related transcription factor 2
  Uniprot ID: Q13950
  ENSP ID: ENSP00000360486
MASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 76190 - protein, 499 aa, Homo sapiens; identical to SEQ ID NO: 76189
  Payload ID: 15201
  Gene Symbol: RUNX2
  Gene Name: runt-related transcription factor 2
  Uniprot ID: Q13950
  ENSP ID: ENSP00000360491

SEQ ID NO: 76191 - protein, 521 aa, Homo sapiens
  Payload ID: 15201
  Gene Symbol: RUNX2
  Gene Name: runt-related transcription factor 2
  Uniprot ID: Q13950
  ENSP ID: ENSP00000360493
MASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 76192 - protein, 521 aa, Homo sapiens; identical to SEQ ID NO: 76191
  Payload ID: 15201
  Gene Symbol: RUNX2
  Gene Name: runt-related transcription factor 2
  Uniprot ID: Q13950
  ENSP ID: ENSP00000420707

SEQ ID NO: 76193 - protein, 542 aa, Homo sapiens
  Payload ID: 15201
  Gene Symbol: RUNX2
  Gene Name: runt-related transcription factor 2
  ENSP ID: ENSP00000458178
MASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDSEPSTLDSQSSTTLFLSSEEPGPSTAALPSPSSSSCEPQAFSPGPPALPPLLPPLPAASAPPGPGASRRTGRYSVVASSPEAAPRLVDWLPGCPSTISPSTRGDDKERPPPVLAPAEGPERSRAPRPSTAGREEGTVDAGTSPPPRARPAAAASLEAHVGDILVELRTMNGHLDSIARALTKLASSLGPQPEPLPDVSDAN

SEQ ID NO: 76194 - protein, 276 aa, Homo sapiens
  Payload ID: 15201
  Gene Symbol: RUNX2
  Gene Name: runt-related transcription factor 2
  ENSP ID: ENSP00000460188
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRNPRQAQSSPPWSYDQSYPSYLSQMTSPSIHSTTPLSSTRGTGLPAITDVPRRISARSRYSLR

SEQ ID NO: 76195 - protein, 37 aa, Homo sapiens
  Payload ID: 15201
  Gene Symbol: RUNX2
  Gene Name: runt-related transcription factor 2
  ENSP ID: ENSP00000461357
MASNSLFSTVTPCQQNFFWGGSPRRGTRWDCGYCHGG

SEQ ID NO: 76196 - protein, 485 aa, Homo sapiens
  Payload ID: 15201
  Gene Symbol: RUNX2
  Gene Name: runt-related transcription factor 2
  ENSP ID: ENSP00000485863
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 76197 - protein, 415 aa, Homo sapiens
  Payload ID: 15202
  Gene Symbol: RUNX3
  Gene Name: runt-related transcription factor 3
  Uniprot ID: Q13761
  ENSP ID: ENSP00000308051
MRIPVDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 76198 - protein, 429 aa, Homo sapiens
  Payload ID: 15202
  Gene Symbol: RUNX3
  Gene Name: runt-related transcription factor 3
  Uniprot ID: Q13761
  ENSP ID: ENSP00000343477
MASNSIFDSFPTYSPTFIRDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 76199 - protein, 429 aa, Homo sapiens; identical to SEQ ID NO: 76198
  Payload ID: 15202
  Gene Symbol: RUNX3
  Gene Name: runt-related transcription factor 3
  Uniprot ID: Q13761
  ENSP ID: ENSP00000382800

SEQ ID NO: 76200 - protein, 456 aa, Homo sapiens
  Payload ID: 15203
  Gene Symbol: RUVBL1
  Gene Name: RuvB-like AAA ATPase 1
  Uniprot ID: Q9Y265
  ENSP ID: ENSP00000318297
MKIEEVKSTTKTQRIASHSHVKGLGLDESGLAKQAASGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 76201 - protein, 267 aa, Homo sapiens
  Payload ID: 15203
  Gene Symbol: RUVBL1
  Gene Name: RuvB-like AAA ATPase 1
  ENSP ID: ENSP00000417254
RQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGLGDGINFAPYRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 76202 - protein, 222 aa, Homo sapiens
  Payload ID: 15203
  Gene Symbol: RUVBL1
  Gene Name: RuvB-like AAA ATPase 1
  ENSP ID: ENSP00000417370
  MOD_RES (1)..(1): Any amino acid
XKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRSHDSMNMLVQLIWKPAAFKYHLIVSTQYDDSAPHRVGDCTQGILKLKSRPWKLPGVGSGHTWK

SEQ ID NO: 76203 - protein, 315 aa, Homo sapiens
  Payload ID: 15203
  Gene Symbol: RUVBL1
  Gene Name: RuvB-like AAA ATPase 1
  ENSP ID: ENSP00000420738
MAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQVP

SEQ ID NO: 76204 - protein, 131 aa, Homo sapiens
  Payload ID: 15203
  Gene Symbol: RUVBL1
  Gene Name: RuvB-like AAA ATPase 1
  ENSP ID: ENSP00000463669
KLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLR

SEQ ID NO: 76205 - protein, 259 aa, Homo sapiens
  Payload ID: 15204
  Gene Symbol: RUVBL2
  Gene Name: RuvB-like AAA ATPase 2
  ENSP ID: ENSP00000221413
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKGRDHHRQGDGQDLQAGPLLHTRPRLRRYGLPDQVRAVPRWGAPETQGGGAHRVPARDRRHQLSHPGLPGALLR

SEQ ID NO: 76206 - protein, 109 aa, Homo sapiens
  Payload ID: 15204
  Gene Symbol: RUVBL2
  Gene Name: RuvB-like AAA ATPase 2
  ENSP ID: ENSP00000469189
MVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGT

SEQ ID NO: 76207 - protein, 39 aa, Homo sapiens
  Payload ID: 15204
  Gene Symbol: RUVBL2
  Gene Name: RuvB-like AAA ATPase 2
  ENSP ID: ENSP00000469488
MATVTATTKVPEIRDVTRIERIEMEFPRVSQDGLDLLTS

SEQ ID NO: 76208 - protein, 44 aa, Homo sapiens
  Payload ID: 15204
  Gene Symbol: RUVBL2
  Gene Name: RuvB-like AAA ATPase 2
  ENSP ID: ENSP00000469760
MATVELQLSKSSWRNGRFRSPWRQCVMRRVVGPCASSHLGALDC

SEQ ID NO: 76209 - protein, 354 aa, Homo sapiens
  Payload ID: 15204
  Gene Symbol: RUVBL2
  Gene Name: RuvB-like AAA ATPase 2
  ENSP ID: ENSP00000471524
MVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRVQKCRWMTSSGSTHSSWTSPAPRST

SEQ ID NO: 76210 - protein, 50 aa, Homo sapiens
  Payload ID: 15204
  Gene Symbol: RUVBL2
  Gene Name: RuvB-like AAA ATPase 2
  ENSP ID: ENSP00000471538
MATVTATTKVPEIRDVTRIERIGAHSHIRGLGLDDALEPRQLPDVVEMPW

SEQ ID NO: 76211 - protein, 463 aa, Homo sapiens
  Payload ID: 15204
  Gene Symbol: RUVBL2
  Gene Name: RuvB-like AAA ATPase 2
  Uniprot ID: Q9Y230
  ENSP ID: ENSP00000473172
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 76212 - protein, 354 aa, Homo sapiens; identical to SEQ ID NO: 76209
  Payload ID: 15204
  Gene Symbol: RUVBL2
  Gene Name: RuvB-like AAA ATPase 2
  ENSP ID: ENSP00000486242

SEQ ID NO: 76213 - protein, 243 aa, Homo sapiens
  Payload ID: 15205
  Gene Symbol: RWDD1
  Gene Name: RWD domain containing 1
  Uniprot ID: Q9H446
  ENSP ID: ENSP00000420357
MTDYGEEQRNELEALESIYPDSFTVLSENPPSFTITVTSEAGENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 76214 - protein, 67 aa, Homo sapiens
  Payload ID: 15205
  Gene Symbol: RWDD1
  Gene Name: RWD domain containing 1
  ENSP ID: ENSP00000428704
MVMIFTLVTAVQEKLNEIVDQIKTRREEEKKQKEKEAEEAEKQLFHGTPVTIENFLNWKAKFDAELL

SEQ ID NO: 76215 - protein, 147 aa, Homo sapiens
  Payload ID: 15205
  Gene Symbol: RWDD1
  Gene Name: RWD domain containing 1
  Uniprot ID: Q9H446
  ENSP ID: ENSP00000428778
MVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 76216 - protein, 51 aa, Homo sapiens
  Payload ID: 15205
  Gene Symbol: RWDD1
  Gene Name: RWD domain containing 1
  ENSP ID: ENSP00000429070
MVMIFTLVTAVQEKLNEIVDQIKTRREEEKKQKEKEAEEAEKQLFHGTPVT

SEQ ID NO: 76217 - protein, 72 aa, Homo sapiens
  Payload ID: 15205
  Gene Symbol: RWDD1
  Gene Name: RWD domain containing 1
  ENSP ID: ENSP00000429942
MVMIFTLVTAVQEKLNEIVDQIKTRREEEKKQKEKEAEEAEKQLFHGTPVTIENFLNWKAKFDAELLEIKKK

SEQ ID NO: 76218 - protein, 292 aa, Homo sapiens
  Payload ID: 15206
  Gene Symbol: RWDD2A
  Gene Name: RWD domain containing 2A
  Uniprot ID: Q9UIY3
  ENSP ID: ENSP00000358739
MSASVKESLQLQLLEMEMLFSMFPNQGEVKLEDVNALTNIKRYLEGTREALPPKIEFVITLQIEEPKVKIDLQVTMPHSYPYVALQLFGRSSELDRHQQLLLNKGLTSYIGTFDPGELCVCAAIQWLQDNSASYFLNRKLVYEPSTQAKPVKNTFLRMWIYSHHIYQQDLRKKILDVGKRLDVTGFCMTGKPGIICVEGFKEHCEEFWHTIRYPNWKHISCKHAESVETEGNGEDLRLFHSFEELLLEAHGDYGLRNDYHMNLGQFLEFLKKHKSEHVFQILFGIESKSSDS

SEQ ID NO: 76219 - protein, 319 aa, Homo sapiens
  Payload ID: 15207
  Gene Symbol: RWDD2B
  Gene Name: RWD domain containing 2B
  Uniprot ID: P57060
  ENSP ID: ENSP00000418693
MKIELSMQPWNPGYSSEGATAQETYTCPKMIEMEQAEAQLAELDLLASMFPGENELIVNDQLAVAELKDCIEKKTMEGRSSKVYFTINMNLDVSDEKMAMFSLACILPFKYPAVLPEITVRSVLLSRSQQTQLNTDLTAFLQKHCHGDVCILNATEWVREHASGYVSRDTSSSPTTGSTVQSVDLIFTRLWIYSHHIYNKCKRKNILEWAKELSLSGFSMPGKPGVVCVEGPQSACEEFWSRLRKLNWKRILIRHREDIPFDGTNDETERQRKFSIFEEKVFSVNGARGNHMDFGQLYQFLNTKGCGDVFQMFFGVEGQ

SEQ ID NO: 76220 - protein, 195 aa, Homo sapiens
  Payload ID: 15208
  Gene Symbol: RWDD3
  Gene Name: RWD domain containing 3
  Uniprot ID: Q9Y3V2
  ENSP ID: ENSP00000263893
MAEPVQEELSVLAAIFCRPHEWEVLSRSETDGTVFRIHTKAEGFMDVDIPLELVFHLPVNYPSCLPGISINSEQLTRAQCVTVKENLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPKS

SEQ ID NO: 76221 - protein, 267 aa, Homo sapiens
  Payload ID: 15208
  Gene Symbol: RWDD3
  Gene Name: RWD domain containing 3
  Uniprot ID: Q9Y3V2
  ENSP ID: ENSP00000359221
MAEPVQEELSVLAAIFCRPHEWEVLSRSETDGTVFRIHTKAEGFMDVDIPLELVFHLPVNYPSCLPGISINSEQLTRAQCVTVKENLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKEYLILQKTSKVDVDSSGKKCKEKMISVLFETKVQTEHKRFLAFEVKEYSALDELQKEFETAGLKKLFSEFVLALVK

SEQ ID NO: 76222 - protein, 187 aa, Homo sapiens
  Payload ID: 15209
  Gene Symbol: RWDD4
  Gene Name: RWD domain containing 4
  ENSP ID: ENSP00000332177
MSANEDQEMELEALRSIYEGDESFRELSPVSFQYRIGENGDPKAFLIEISWTETYPQTPPILSMNAFFNNTISSAVKQSILAKLQEAVEANLGTAMTYTLFEYAKDNKEQFMENHNPINSATSISNIISIETPNTAPSSKKKDKKEQLSKAQKRKLADKTDHKGELPRGWNWVDVVKLSKTGSKDDE

SEQ ID NO: 76223 - protein, 188 aa, Homo sapiens
  Payload ID: 15209
  Gene Symbol: RWDD4
  Gene Name: RWD domain containing 4
  Uniprot ID: Q6NW29
  ENSP ID: ENSP00000388920
MSANEDQEMELEALRSIYEGDESFRELSPVSFQYRIGENGDPKAFLIEISWTETYPQTPPILSMNAFFNNTISSAVKQSILAKLQEAVEANLGTAMTYTLFEYAKDNKEQFMENHNPINSATSISNIISIETPNTAPSSKKKDKKEQLSKAQKRKLADKTDHKGELPRGWNWVDVVKHLSKTGSKDDE

SEQ ID NO: 76224 - protein, 53 aa, Homo sapiens
  Payload ID: 15209
  Gene Symbol: RWDD4
  Gene Name: RWD domain containing 4
  ENSP ID: ENSP00000420945
MSANEDQEMELEALRSIYEGDESFRELSPVSFQYRIISCKAEYISQATGSSRS

SEQ ID NO: 76225 - protein, 43 aa, Homo sapiens
  Payload ID: 15209
  Gene Symbol: RWDD4
  Gene Name: RWD domain containing 4
  ENSP ID: ENSP00000422970
MELEALRSIYEGDESFRELSPVSFQYRIGENGDPKAFLIEISW

SEQ ID NO: 76226 - protein, 125 aa, Homo sapiens
  Payload ID: 15209
  Gene Symbol: RWDD4
  Gene Name: RWD domain containing 4
  ENSP ID: ENSP00000423598
MNAFFNNTISSAVKQSILAKLQEAVEANLGTAMTYTLFEYAKDNKEQFMENHNPINSATSISNIISIETPNTAPSSKKKDKKEQLSKAQKRKLADKTDHKGELPRGWNWVDVVKHLSKTGSKDDE

SEQ ID NO: 76227 - protein, 93 aa, Homo sapiens
  Payload ID: 15209
  Gene Symbol: RWDD4
  Gene Name: RWD domain containing 4
  Uniprot ID: Q6NW29
  ENSP ID: ENSP00000426329
MTYTLFEYAKDNKEQFMENHNPINSATSISNIISIETPNTAPSSKKKDKKEQLSKAQKRKLADKTDHKGELPRGWNWVDVVKHLSKTGSKDDE

SEQ ID NO: 76228 - protein, 44 aa, Homo sapiens
  Payload ID: 15209
  Gene Symbol: RWDD4
  Gene Name: RWD domain containing 4
  ENSP ID: ENSP00000427164
MSANEDQEMELEALRSIYEGDESFRELSPVSFQYRVKMVIPKPS

SEQ ID NO: 76229 - protein, 5033 aa, Homo sapiens
  Payload ID: 15210
  Gene Symbol: RYR1
  Gene Name: ryanodine receptor 1 (skeletal)
  Uniprot ID: P21817
  ENSP ID: ENSP00000347667
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 76230 - protein, 5038 aa, Homo sapiens
  Payload ID: 15210
  Gene Symbol: RYR1
  Gene Name: ryanodine receptor 1 (skeletal)
  Uniprot ID: P21817
  ENSP ID: ENSP00000352608
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 76231 - protein, 5032 aa, Homo sapiens
  Payload ID: 15210
  Gene Symbol: RYR1
  Gene Name: ryanodine receptor 1 (skeletal)
  ENSP ID: ENSP00000354254
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGRGAPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 76232 - protein, 171 aa, Homo sapiens
  Payload ID: 15210
  Gene Symbol: RYR1
  Gene Name: ryanodine receptor 1 (skeletal)
  ENSP ID: ENSP00000470848
EKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTGEKVMADDEFTQDLFRFLQLLCEGHNNGALQWLPKFYTRGGFLYFRSRKDLREKTAWHLKINLLE

SEQ ID NO: 76233 - protein, 886 aa, Homo sapiens
  Payload ID: 15210
  Gene Symbol: RYR1
  Gene Name: ryanodine receptor 1 (skeletal)
  ENSP ID: ENSP00000470927
  MOD_RES (1)..(1): Any amino acid
XNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITRDRRPSCGQLSSHPGPLPGCQDSDEVRP

SEQ ID NO: 76234 - protein, 79 aa, Homo sapiens
  Payload ID: 15210
  Gene Symbol: RYR1
  Gene Name: ryanodine receptor 1 (skeletal)
  ENSP ID: ENSP00000471404
  MOD_RES (1)..(1): Any amino acid
XRLHTRGAAEMVLQMISACKGETGAMVSSTLKLGISILNGGNAEVQQKMLDYLKDKKEVGFFQSIQALMQTCRREGHGG

SEQ ID NO: 76235 - protein, 733 aa, Homo sapiens
  Payload ID: 15210
  Gene Symbol: RYR1
  Gene Name: ryanodine receptor 1 (skeletal)
  ENSP ID: ENSP00000471601
  MOD_RES (1)..(1): Any amino acid
XTCCSRPPPSLSLWTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTL

SEQ ID NO: 76236 - protein, 144 aa, Homo sapiens
  Payload ID: 15210
  Gene Symbol: RYR1
  Gene Name: ryanodine receptor 1 (skeletal)
  ENSP ID: ENSP00000472126
  MOD_RES (1)..(1): Any amino acid
XELPPEPEPEPEPELEPEKADAENGEKEEVPEPTPEPPKKQAPPSPPPKKEEAGGEFWGELEVQRVKFLVSDSPPGEDDMEGSAAGDVSGAGSGGSSGWGLGAGEEAEGDEDENMVYYFLEESTGYMEPALRCLSLLHTLVAFL

SEQ ID NO: 76237 - protein, 287 aa, Homo sapiens
  Payload ID: 15210
  Gene Symbol: RYR1
  Gene Name: ryanodine receptor 1 (skeletal)
  ENSP ID: ENSP00000472497
RGPGSVGPGLGWKLRSGGGVRTLTLLVETRFSFCRTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNE

SEQ ID NO: 76238 - protein, 4950 aa, Homo sapiens
  Payload ID: 15211
  Gene Symbol: RYR2
  Gene Name: ryanodine receptor 2 (cardiac)
  ENSP ID: ENSP00000353174
DDEVVLQCTATIHKEQQKLCLAAEGFGNRLCFLESTSNSKNVPPDLSICTFVLEQSLSVRALQEMLANTVEKSEGQVDVEKWLFSLKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQVIYLVTAAFSRRAYVLFVCFHRGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 76239 - protein, 4967 aa, Homo sapiens
  Payload ID: 15211
  Gene Symbol: RYR2
  Gene Name: ryanodine receptor 2 (cardiac)
  Uniprot ID: Q92736
  ENSP ID: ENSP00000355533
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 76240 - protein, 4869 aa, Homo sapiens
  Payload ID: 15212
  Gene Symbol: RYR3
  Gene Name: ryanodine receptor 3
  Uniprot ID: Q15413
  ENSP ID: ENSP00000373884
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 76241 - protein, 4865 aa, Homo sapiens
  Payload ID: 15212
  Gene Symbol: RYR3
  Gene Name: ryanodine receptor 3
  Uniprot ID: Q15413
  ENSP ID: ENSP00000399610
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 76242 - protein, 4873 aa, Homo sapiens
  Payload ID: 15212
  Gene Symbol: RYR3
  Gene Name: ryanodine receptor 3
  ENSP ID: ENSP00000483166
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGNDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRQHMHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 76243 - protein, 4870 aa, Homo sapiens
  Payload ID: 15212
  Gene Symbol: RYR3
  Gene Name: ryanodine receptor 3
  ENSP ID: ENSP00000489262
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 76244 - protein, 46 aa, Homo sapiens
  Payload ID: 15212
  Gene Symbol: RYR3
  Gene Name: ryanodine receptor 3
  ENSP ID: ENSP00000489294
  MOD_RES (1)..(1): Any amino acid
XEDEIQFLRTYIPPDLCVCNFVLEQSLSVRALQEMLANTGENGGEG

SEQ ID NO: 76245 - protein, 615 aa, Homo sapiens
  Payload ID: 15212
  Gene Symbol: RYR3
  Gene Name: ryanodine receptor 3
  ENSP ID: ENSP00000489346
RVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 76246 - protein, 4859 aa, Homo sapiens
  Payload ID: 15212
  Gene Symbol: RYR3
  Gene Name: ryanodine receptor 3
  ENSP ID: ENSP00000489529
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHKINNFFLSTFQQVWLEKVNEKTQYDRLIPILMKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTREKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 76247 - protein, 995 aa, Homo sapiens
  Payload ID: 15213
  Gene Symbol: SRBD1
  Gene Name: S1 RNA binding domain 1
  Uniprot ID: Q8N5C6
  ENSP ID: ENSP00000263736
MSSLPRRAKVQVQDVVLKDEFSSFSELSSASEEDDKEDSAWEPQKKVPRSRKQPPPKESKPKRMPRVKKNAPQISDGSEVVVVKEELNSSVAIADTALEDRKNKLDTVQTLKTAKTKQKCAAQPHTVRRTKKLKVEEETSKASNLEGESNSSETPSTSTVWGGTCKKEENDDDFTFGQSALKKIKTETYPQGQPVKFPANANSTKEEVEMNWDMVQVLSERTNIEPWVCANIIRLFNDDNTIPFIIRYRKELINNLDADSLREVQQTLEELRAVAKKVHSTIQKIKKEGKMSECLLKAMLNCKTFEELEHVSAPYKTGSKGTKAQRARQLGLEGAARALLEKPGELSLLSYIRPDVKGLSTLQDIEIGVQHILADMIAKDKDTLDFIRNLCQKRHVCIQSSLAKVSSKKVNEKDVDKFLLYQHFSCNIRNIHHHQILAINRGENLKVLTVKVNISDGVKDEFCRWCIQNRWRPRSFARPELMKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVSPEANKEMPGLDPNLRSAVSIARRVQDPLAELVKIEPKHIGVGMYQHDVSQTLLKATLDSVVEECVSFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 76248 - protein, 94 aa, Homo sapiens
  Payload ID: 15214
  Gene Symbol: S100A1
  Gene Name: S100 calcium binding protein A1
  Uniprot ID: P23297
  ENSP ID: ENSP00000292169
MGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 76249 - protein, 53 aa, Homo sapiens
  Payload ID: 15214
  Gene Symbol: S100A1
  Gene Name: S100 calcium binding protein A1
  ENSP ID: ENSP00000357685
MGSELETAMETLINVFHAHSGKEGDKYKLSKKELKELLQTELSGFLDVKELML

SEQ ID NO: 76250 - protein, 147 aa, Homo sapiens
  Payload ID: 15214
  Gene Symbol: S100A1
  Gene Name: S100 calcium binding protein A1
  ENSP ID: ENSP00000357687
MEEPQTKTPSAEFPPYRAQPAQPATAPAATFATLAICPEPAPTSGPGQPCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 76251 - protein, 34 aa, Homo sapiens
  Payload ID: 15214
  Gene Symbol: S100A1
  Gene Name: S100 calcium binding protein A1
  ENSP ID: ENSP00000389708
MGSELETAMETLINVFHAHSGKEGDKYKLSKKEL

SEQ ID NO: 76252 - protein, 97 aa, Homo sapiens
  Payload ID: 15215
  Gene Symbol: S100A10
  Gene Name: S100 calcium binding protein A10
  Uniprot ID: P60903
  ENSP ID: ENSP00000357799
MPSQMEHAMETMMFTFHKFAGDKGYLTKEDLRVLMEKEFPGFLENQKDPLAVDKIMKDLDQCRDGKVGFQSFFSLIAGLTIACNDYFVVHMKQKGKK

SEQ ID NO: 76253 - protein, 97 aa, Homo sapiens; identical to SEQ ID NO: 76252
  Payload ID: 15215
  Gene Symbol: S100A10
  Gene Name: S100 calcium binding protein A10
  Uniprot ID: P60903
  ENSP ID: ENSP00000357801

SEQ ID NO: 76254 - protein, 105 aa, Homo sapiens
  Payload ID: 15216
  Gene Symbol: S100A11
  Gene Name: S100 calcium binding protein A11
  Uniprot ID: P31949
  ENSP ID: ENSP00000271638
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 76255 - protein, 92 aa, Homo sapiens
  Payload ID: 15217
  Gene Symbol: S100A12
  Gene Name: S100 calcium binding protein A12
  Uniprot ID: P80511
  ENSP ID: ENSP00000357726
MTKLEEHLEGIVNIFHQYSVRKGHFDTLSKGELKQLLTKELANTIKNIKDKAVIDEIFQGLDANQDEQVDFQEFISLVAIALKAAHYHTHKE

SEQ ID NO: 76256 - protein, 98 aa, Homo sapiens
  Payload ID: 15218
  Gene Symbol: S100A13
  Gene Name: S100 calcium binding protein A13
  Uniprot ID: Q99584
  ENSP ID: ENSP00000344822
MAAEPLTELEESIETVVTTFFTFARQEGRKDSLSVNEFKELVTQQLPHLLKDVGSLDEKMKSLDVNQDSELKFNEYWRLIGELAKEIRKKKDLKIRKK

SEQ ID NO: 76257 - protein, 98 aa, Homo sapiens; identical to SEQ ID NO: 76256
  Payload ID: 15218
  Gene Symbol: S100A13
  Gene Name: S100 calcium binding protein A13
  Uniprot ID: Q99584
  ENSP ID: ENSP00000376398

SEQ ID NO: 76258 - protein, 98 aa, Homo sapiens; identical to SEQ ID NO: 76256
  Payload ID: 15218
  Gene Symbol: S100A13
  Gene Name: S100 calcium binding protein A13
  Uniprot ID: Q99584
  ENSP ID: ENSP00000376399

SEQ ID NO: 76259 - protein, 98 aa, Homo sapiens; identical to SEQ ID NO: 76256
  Payload ID: 15218
  Gene Symbol: S100A13
  Gene Name: S100 calcium binding protein A13
  Uniprot ID: Q99584
  ENSP ID: ENSP00000392767

SEQ ID NO: 76260 - protein, 104 aa, Homo sapiens
  Payload ID: 15219
  Gene Symbol: S100A14
  Gene Name: S100 calcium binding protein A14
  Uniprot ID: Q9HCY8
  ENSP ID: ENSP00000340463
MGQCRSANAEDAQEFSDVERAIETLIKNFHQYSVEGGKETLTPSELRDLVTQQLPHLMPSNCGLEEKIANLGSCNDSKLEFRSFWELIGEAAKSVKLERPVRGH

SEQ ID NO: 76261 - protein, 104 aa, Homo sapiens; identical to SEQ ID NO: 76260
  Payload ID: 15219
  Gene Symbol: S100A14
  Gene Name: S100 calcium binding protein A14
  Uniprot ID: Q9HCY8
  ENSP ID: ENSP00000357690

SEQ ID NO: 76262 - protein, 104 aa, Homo sapiens; identical to SEQ ID NO: 76260
  Payload ID: 15219
  Gene Symbol: S100A14
  Gene Name: S100 calcium binding protein A14
  Uniprot ID: Q9HCY8
  ENSP ID: ENSP00000357691

SEQ ID NO: 76263 - protein, 104 aa, Homo sapiens; identical to SEQ ID NO: 76260
  Payload ID: 15219
  Gene Symbol: S100A14
  Gene Name: S100 calcium binding protein A14
  Uniprot ID: Q9HCY8
  ENSP ID: ENSP00000420296

SEQ ID NO: 76264 - protein, 103 aa, Homo sapiens
  Payload ID: 15220
  Gene Symbol: S100A16
  Gene Name: S100 calcium binding protein A16
  Uniprot ID: Q96FQ6
  ENSP ID: ENSP00000357692
MSDCYTELEKAVIVLVENFYKYVSKYSLVKNKISKSSFREMLQKELNHMLSDTGNRKAADKLIQNLDANHDGRISFDEYWTLIGGITGPIAKLIHEQEQQSSS

SEQ ID NO: 76265 - protein, 103 aa, Homo sapiens; identical to SEQ ID NO: 76264
  Payload ID: 15220
  Gene Symbol: S100A16
  Gene Name: S100 calcium binding protein A16
  Uniprot ID: Q96FQ6
  ENSP ID: ENSP00000357693

SEQ ID NO: 76266 - protein, 103 aa, Homo sapiens; identical to SEQ ID NO: 76264
  Payload ID: 15220
  Gene Symbol: S100A16
  Gene Name: S100 calcium binding protein A16
  Uniprot ID: Q96FQ6
  ENSP ID: ENSP00000357694

SEQ ID NO: 76267 - protein, 103 aa, Homo sapiens; identical to SEQ ID NO: 76264
  Payload ID: 15220
  Gene Symbol: S100A16
  Gene Name: S100 calcium binding protein A16
  Uniprot ID: Q96FQ6
  ENSP ID: ENSP00000357695

SEQ ID NO: 76268 - protein, 95 aa, Homo sapiens
  Payload ID: 15221
  Gene Symbol: S100A2
  Gene Name: S100 calcium binding protein A2
  ENSP ID: ENSP00000357696
MCSSLEQALAVLVTTFHKYSCQEGDKFKLSKGEMKELLHKELPSFVGHSREPCAVRAFRVHLFNPVIGDLRNQSPEGKSDCPKITQHWRKWMRRG

SEQ ID NO: 76269 - protein, 97 aa, Homo sapiens
  Payload ID: 15221
  Gene Symbol: S100A2
  Gene Name: S100 calcium binding protein A2
  Uniprot ID: P29034
  ENSP ID: ENSP00000357697
MCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 76270 - protein, 97 aa, Homo sapiens; identical to SEQ ID NO: 76269
  Payload ID: 15221
  Gene Symbol: S100A2
  Gene Name: S100 calcium binding protein A2
  Uniprot ID: P29034
  ENSP ID: ENSP00000357698

SEQ ID NO: 76271 - protein, 97 aa, Homo sapiens; identical to SEQ ID NO: 76269
  Payload ID: 15221
  Gene Symbol: S100A2
  Gene Name: S100 calcium binding protein A2
  Uniprot ID: P29034
  ENSP ID: ENSP00000357699

SEQ ID NO: 76272 - protein, 97 aa, Homo sapiens; identical to SEQ ID NO: 76269
  Payload ID: 15221
  Gene Symbol: S100A2
  Gene Name: S100 calcium binding protein A2
  Uniprot ID: P29034
  ENSP ID: ENSP00000473260

SEQ ID NO: 76273 - protein, 64 aa, Homo sapiens
  Payload ID: 15221
  Gene Symbol: S100A2
  Gene Name: S100 calcium binding protein A2
  ENSP ID: ENSP00000473489
MKELLHKELPSFVGEKVDEEGLKKLMGSLDENSDQQVDFQEYAVFLALITVMCNDFFQGCPDRP

SEQ ID NO: 76274 - protein, 101 aa, Homo sapiens
  Payload ID: 15222
  Gene Symbol: S100A3
  Gene Name: S100 calcium binding protein A3
  Uniprot ID: P33764
  ENSP ID: ENSP00000357701
MARPLEQAVAAIVCTFQEYAGRCGDKYKLCQAELKELLQKELATWTPTEFRECDYNKFMSVLDTNKDCEVDFVEYVRSLACLCLYCHEYFKDCPSEPPCSQ

SEQ ID NO: 76275 - protein, 101 aa, Homo sapiens; identical to SEQ ID NO: 76274
  Payload ID: 15222
  Gene Symbol: S100A3
  Gene Name: S100 calcium binding protein A3
  Uniprot ID: P33764
  ENSP ID: ENSP00000357702

SEQ ID NO: 76276 - protein, 101 aa, Homo sapiens
  Payload ID: 15223
  Gene Symbol: S100A4
  Gene Name: S100 calcium binding protein A4
  Uniprot ID: P26447
  ENSP ID: ENSP00000346294
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 76277 - protein, 101 aa, Homo sapiens; identical to SEQ ID NO: 76276
  Payload ID: 15223
  Gene Symbol: S100A4
  Gene Name: S100 calcium binding protein A4
  Uniprot ID: P26447
  ENSP ID: ENSP00000357703

SEQ ID NO: 76278 - protein, 101 aa, Homo sapiens; identical to SEQ ID NO: 76276
  Payload ID: 15223
  Gene Symbol: S100A4
  Gene Name: S100 calcium binding protein A4
  Uniprot ID: P26447
  ENSP ID: ENSP00000357704

SEQ ID NO: 76279 - protein, 101 aa, Homo sapiens; identical to SEQ ID NO: 76276
  Payload ID: 15223
  Gene Symbol: S100A4
  Gene Name: S100 calcium binding protein A4
  Uniprot ID: P26447
  ENSP ID: ENSP00000357705

SEQ ID NO: 76280 - protein, 92 aa, Homo sapiens
  Payload ID: 15224
  Gene Symbol: S100A5
  Gene Name: S100 calcium binding protein A5
  Uniprot ID: P33763
  ENSP ID: ENSP00000357706
METPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 76281 - protein, 92 aa, Homo sapiens; identical to SEQ ID NO: 76280
  Payload ID: 15224
  Gene Symbol: S100A5
  Gene Name: S100 calcium binding protein A5
  Uniprot ID: P33763
  ENSP ID: ENSP00000357707

SEQ ID NO: 76282 - protein, 90 aa, Homo sapiens
  Payload ID: 15225
  Gene Symbol: S100A6
  Gene Name: S100 calcium binding protein A6
  Uniprot ID: P06703
  ENSP ID: ENSP00000357708
MACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 76283 - protein, 90 aa, Homo sapiens; identical to SEQ ID NO: 76282
  Payload ID: 15225
  Gene Symbol: S100A6
  Gene Name: S100 calcium binding protein A6
  Uniprot ID: P06703
  ENSP ID: ENSP00000357709

SEQ ID NO: 76284 - protein, 85 aa, Homo sapiens
  Payload ID: 15225
  Gene Symbol: S100A6
  Gene Name: S100 calcium binding protein A6
  ENSP ID: ENSP00000473547
MACPLDQAIGLLVAIFHKYSGREGDKHTLSKKELKELIQKELTIGSKLQDAEIARLMEDLDRNKDQEVNFQEYVTFLGALALIYN

SEQ ID NO: 76285 - protein, 90 aa, Homo sapiens; identical to SEQ ID NO: 76282
  Payload ID: 15225
  Gene Symbol: S100A6
  Gene Name: S100 calcium binding protein A6
  Uniprot ID: P06703
  ENSP ID: ENSP00000473589

SEQ ID NO: 76286 - protein, 101 aa, Homo sapiens
  Payload ID: 15226
  Gene Symbol: S100A7
  Gene Name: S100 calcium binding protein A7
  Uniprot ID: P31151
  ENSP ID: ENSP00000357711
MSNTQAERSIIGMIDMFHKYTRRDDKIEKPSLLTMMKENFPNFLSACDKKGTNYLADVFEKKDKNEDKKIDFSEFLSLLGDIATDYHKQSHGAAPCSGGSQ

SEQ ID NO: 76287 - protein, 101 aa, Homo sapiens; identical to SEQ ID NO: 76286
  Payload ID: 15226
  Gene Symbol: S100A7
  Gene Name: S100 calcium binding protein A7
  Uniprot ID: P31151
  ENSP ID: ENSP00000357712

SEQ ID NO: 76288 - protein, 101 aa, Homo sapiens
  Payload ID: 15227
  Gene Symbol: S100A7A
  Gene Name: S100 calcium binding protein A7A
  Uniprot ID: Q86SG5
  ENSP ID: ENSP00000329008
MSNTQAERSIIGMIDMFHKYTGRDGKIEKPSLLTMMKENFPNFLSACDKKGIHYLATVFEKKDKNEDKKIDFSEFLSLLGDIAADYHKQSHGAAPCSGGSQ

SEQ ID NO: 76289 - protein, 101 aa, Homo sapiens; identical to SEQ ID NO: 76288
  Payload ID: 15227
  Gene Symbol: S100A7A
  Gene Name: S100 calcium binding protein A7A
  Uniprot ID: Q86SG5
  ENSP ID: ENSP00000357717

SEQ ID NO: 76290 - protein, 101 aa, Homo sapiens; identical to SEQ ID NO: 76288
  Payload ID: 15227
  Gene Symbol: S100A7A
  Gene Name: S100 calcium binding protein A7A
  Uniprot ID: Q86SG5
  ENSP ID: ENSP00000357718

SEQ ID NO: 76291 - protein, 112 aa, Homo sapiens
  Payload ID: 15228
  Gene Symbol: S100A7L2
  Gene Name: S100 calcium binding protein A7-like 2
  Uniprot ID: Q5SY68
  ENSP ID: ENSP00000357714
MLPSSGFLKAKMNIPLGEKVMLDIVAMFRQYSGDDGRMDMPGLVNLMKENFPNFLSGCEKSDMDYLSNALEKKDDNKDKKVNYSEFLSLLGDITIDHHKIMHGVAPCSGGSQ

SEQ ID NO: 76292 - protein, 93 aa, Homo sapiens
  Payload ID: 15229
  Gene Symbol: S100A8
  Gene Name: S100 calcium binding protein A8
  Uniprot ID: P05109
  ENSP ID: ENSP00000357721
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 76293 - protein, 93 aa, Homo sapiens; identical to SEQ ID NO: 76292
  Payload ID: 15229
  Gene Symbol: S100A8
  Gene Name: S100 calcium binding protein A8
  Uniprot ID: P05109
  ENSP ID: ENSP00000357722

SEQ ID NO: 76294 - protein, 114 aa, Homo sapiens
  Payload ID: 15230
  Gene Symbol: S100A9
  Gene Name: S100 calcium binding protein A9
  Uniprot ID: P06702
  ENSP ID: ENSP00000357727
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 76295 - protein, 92 aa, Homo sapiens
  Payload ID: 15231
  Gene Symbol: S100B
  Gene Name: S100 calcium binding protein B
  Uniprot ID: P04271
  ENSP ID: ENSP00000291700
MSELEKAMVALIDVFHQYSGREGDKHKLKKSELKELINNELSHFLEEIKEQEVVDKVMETLDNDGDGECDFQEFMAFVAMVTTACHEFFEHE

SEQ ID NO: 76296 - protein, 94 aa, Homo sapiens
  Payload ID: 15231
  Gene Symbol: S100B
  Gene Name: S100 calcium binding protein B
  ENSP ID: ENSP00000356038
MSELEKAMVALIDVFHQYSGREGDKHKLKKSELKELINNELSHFLERWSLPMLPRLVSNFLCSSYPPALASQSAGITGNQRAGGCGQSHGNTGQ

SEQ ID NO: 76297 - protein, 92 aa, Homo sapiens; identical to SEQ ID NO: 76295
  Payload ID: 15231
  Gene Symbol: S100B
  Gene Name: S100 calcium binding protein B
  Uniprot ID: P04271
  ENSP ID: ENSP00000380769

SEQ ID NO: 76298 - protein, 79 aa, Homo sapiens
  Payload ID: 15232
  Gene Symbol: S100G
  Gene Name: S100 calcium binding protein G
  Uniprot ID: P29377
  ENSP ID: ENSP00000369547
MSTKKSPEELKRIFEKYAAKEGDPDQLSKDELKLLIQAEFPSLLKGPNTLDDLFQELDKNGDGEVSFEEFQVLVKKISQ

SEQ ID NO: 76299 - protein, 95 aa, Homo sapiens
  Payload ID: 15233
  Gene Symbol: S100P
  Gene Name: S100 calcium binding protein P
  Uniprot ID: P25815
  ENSP ID: ENSP00000296370
MTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 76300 - protein, 99 aa, Homo sapiens
  Payload ID: 15234
  Gene Symbol: S100Z
  Gene Name: S100 calcium binding protein Z
  Uniprot ID: Q8WXG8
  ENSP ID: ENSP00000320430
MPTQLEMAMDTMIRIFHRYSGKERKRFKLSKGELKLLLQRELTEFLSCQKETQLVDKIVQDLDANKDNEVDFNEFVVMVAALTVACNDYFVEQLKKKGK

SEQ ID NO: 76301 - protein, 99 aa, Homo sapiens; identical to SEQ ID NO: 76300
  Payload ID: 15234
  Gene Symbol: S100Z
  Gene Name: S100 calcium binding protein Z
  Uniprot ID: Q8WXG8
  ENSP ID: ENSP00000426768

SEQ ID NO: 76302 - protein, 99 aa, Homo sapiens; identical to SEQ ID NO: 76300
  Payload ID: 15234
  Gene Symbol: S100Z
  Gene Name: S100 calcium binding protein Z
  Uniprot ID: Q8WXG8
  ENSP ID: ENSP00000483535

SEQ ID NO: 76303 - protein, 408 aa, Homo sapiens
  Payload ID: 15235
  Gene Symbol: S100PBP
  Gene Name: S100P binding protein
  Uniprot ID: Q96BU1
  ENSP ID: ENSP00000362574
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKVTVAPFNPTVCDALLDKDETDSSKDTEKLSSLGEEMREDGLSPNESKLCTESEGISPNNSAWNGPQLSSSNNNFQQTVSDKNMPDSENPTSVFSRISDHSETPNMELSCRNGGSHKSSCEMRSLVVSTSSNKQDVLNKDSGKMKGHERRLGKVIPVLQTKTRTNVPTFSQSNLEQQKQLYLRSVIAHIEDPEDTNQGISGELCALMDQVHHMQHSKWQHPSDLTTRNYARRQKHLQRYSLTQWVDRNMRSHHRFQRLPDFSYS

SEQ ID NO: 76304 - protein, 408 aa, Homo sapiens; identical to SEQ ID NO: 76303
  Payload ID: 15235
  Gene Symbol: S100PBP
  Gene Name: S100P binding protein
  Uniprot ID: Q96BU1
  ENSP ID: ENSP00000362575

SEQ ID NO: 76305 - protein, 146 aa, Homo sapiens
  Payload ID: 15235
  Gene Symbol: S100PBP
  Gene Name: S100P binding protein
  ENSP ID: ENSP00000431432
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKV

SEQ ID NO: 76306 - protein, 41 aa, Homo sapiens
  Payload ID: 15235
  Gene Symbol: S100PBP
  Gene Name: S100P binding protein
  ENSP ID: ENSP00000431921
MMCSRVPSEQSSGTSLLPKDGAPFSWDSLDEDGLDDSLLEL

SEQ ID NO: 76307 - protein, 120 aa, Homo sapiens
  Payload ID: 15235
  Gene Symbol: S100PBP
  Gene Name: S100P binding protein
  ENSP ID: ENSP00000431940
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLS

SEQ ID NO: 76308 - protein, 5 aa, Homo sapiens
  Payload ID: 15235
  Gene Symbol: S100PBP
  Gene Name: S100P binding protein
  ENSP ID: ENSP00000433456
MMCSR

SEQ ID NO: 76309 - protein, 130 aa, Homo sapiens
  Payload ID: 15235
  Gene Symbol: S100PBP
  Gene Name: S100P binding protein
  ENSP ID: ENSP00000434933
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHT

SEQ ID NO: 76310 - protein, 171 aa, Homo sapiens
  Payload ID: 15235
  Gene Symbol: S100PBP
  Gene Name: S100P binding protein
  ENSP ID: ENSP00000435856
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKVTVAPFNPTVCDALLDKDETDSSKDT

SEQ ID NO: 76311 - protein, 208 aa, Homo sapiens
  Payload ID: 15236
  Gene Symbol: SAA2-SAA4
  Gene Name: SAA2-SAA4 readthrough
  ENSP ID: ENSP00000485552
MKLLTGLVFCSLVLSVSSRSFFSFLGEAFDGARDMWRAYSDMREANYIGSDKYFHARGNYDAAKRGPGGAWAAEVISTMRLFTGIVFCSLVMGVTSESWRSFFKEALQGVGDMGRAYWDIMISNHQNSNRYLYARGNYDAAQRGPGGVWAAKLISRSRVYLQGLIDCYLFGNSSTVLEDSKSNEKAEEWGRSGKDPDRFRPDGLPKKY

SEQ ID NO: 76312 - protein, 587 aa, Homo sapiens
  Payload ID: 15237
  Gene Symbol: SACM1L
  Gene Name: SAC1 suppressor of actin mutations 1-like (yeast)
  Uniprot ID: Q9NTJ5
  ENSP ID: ENSP00000373713
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQLQDNKTFLAMLNHVLNVDGFYFSTTYDLTHTLQRLSNTSPEFQEMSLLERADQRFVWNGHLLRELSAQPEVHRFALPVLHGFITMHSCSINGKYFDWILISRRSCFRAGVRYYVRGIDSEGHAANFVETEQIVHYNGSKASFVQTRGSIPVFWSQRPNLKYKPLPQISKVANHMDGFQRHFDSQVIIYGKQVIINLINQKGSEKPLEQTFATMVSSLGSGMMRYIAFDFHKECKNMRWDRLSILLDQVAEMQDELSYFLVDSAGQVVANQEGVFRSNCMDCLDRTNVIQSLLARRSLQAQLQRLGVLHVGQKLEEQDEFEKIYKNAWADNANACAKQYAGTGALKTDFTRTGKRTHLGLIMDGWNSMIRYYKNNFSDGFRQDSIDLFLGNYSVDELESHSPLSVPRDWKFLALPIIMVVAFSMCIICLLMAGDTWTETLAYVLFWGVASIGTFFIILYNGKDFVDAPRLVQKEKID

SEQ ID NO: 76313 - protein, 287 aa, Homo sapiens
  Payload ID: 15237
  Gene Symbol: SACM1L
  Gene Name: SAC1 suppressor of actin mutations 1-like (yeast)
  ENSP ID: ENSP00000389975
MLHLTDIQLQDNKTFLAMLNHVLNVDGFYFSTTYDLTHTLQRLSNTSPEFQEMSLLERADQRFVWNGHLLRELSAQPEVHRFALPVLHGFITMHSCSINGKYFDWILISRRSCFRAGVRYYVRGIDSEGHAANFVETEQIVHYNGSKASFVQTRGSIPVFWSQRPNLKYKPLPQISKVANHMDGFQRHFDSQVIIYGKQVIINLINQKGSEKPLEQTFATMVSSLGSGMMRYIAFDFHKECKNMRWDRLSILLDQVAEMQDELSGLCWPGGGKPGRRVPKQLHGLSR

SEQ ID NO: 76314 - protein, 484 aa, Homo sapiens
  Payload ID: 15237
  Gene Symbol: SACM1L
  Gene Name: SAC1 suppressor of actin mutations 1-like (yeast)
  ENSP ID: ENSP00000396387
MLHLTDIQLQDNKTFLAMLNHVLNVDGFYFSTTYDLTHTLQRLSNTSPEFQEMSLLERADQRFVWNGHLLRELSAQPEVHRFALPVLHGFITMHSCSINGKYFDWILISRRSCFRAGVRYYVRGIDSEGHAANFVETEQIVHYNGSKASFVQTRGSIPVFWSQRPNLKYKPLPQISKVANHMDGFQRHFDSQVIIYGKQVIINLINQKGSEKPLEQTFATMVSSLGSGMMRYIAFDFHKECKNMRWDRLSILLDQVAEMQDELSYFLVDSAGQVVANQEGVFRSNCMDCLDRTNVIQSLLARRSLQAQLQRLGVLHVGQKLEEQDEFEKIYKNAWADNANACAKQYAGTGALKTDFTRTGKRTHLGLIMDGWNSMIRYYKNNFSDGFRQDSIDLFLGNYSVDELESHSPLSVPRDWKFLALPIIMVVAFSMCIICLLMAGDTWTETLAYVLFWGVASIGTFFIILYNGKDFVDAPRLVQKEKID

SEQ ID NO: 76315 - protein, 71 aa, Homo sapiens
  Payload ID: 15237
  Gene Symbol: SACM1L
  Gene Name: SAC1 suppressor of actin mutations 1-like (yeast)
  ENSP ID: ENSP00000406263
MATAAYEQLKLHITPEKFYVEACDDGADDVLTIDRVSTEVTLAVKKDVPPSAVTRPIFGILGTIHLVAVTR

SEQ ID NO: 76316 - protein, 112 aa, Homo sapiens
  Payload ID: 15237
  Gene Symbol: SACM1L
  Gene Name: SAC1 suppressor of actin mutations 1-like (yeast)
  ENSP ID: ENSP00000411966
MWKLVMMEQMTYLPLTVCPQRLPLQSRKMFLLQLSQDQYLVYWAQSIWWQLQDNKTFLAMLNHVLNVDGFYFSTTYDLTHTLQRLSNTSPEFQEMSLLERADQRFVWNGHLL

SEQ ID NO: 76317 - protein, 187 aa, Homo sapiens
  Payload ID: 15237
  Gene Symbol: SACM1L
  Gene Name: SAC1 suppressor of actin mutations 1-like (yeast)
  ENSP ID: ENSP00000412883
MVSSLGSGMMRYIAFDFHKECKNMRWDRLSILLDQVAEMQDELSYFLVDSAGQVVANQEGVFRSNCMDCLDRTNVIQSLLARRSLQAQLQRLGVLHVGQKLEEQDEFEKIYKNAWADNANACAKQYAGTGALKTDFTRTGKRTHLGLIMDGWNSMIRYYKNNFSDGFRQDSIDLFLGNYSVDELESH

SEQ ID NO: 76318 - protein, 358 aa, Homo sapiens
  Payload ID: 15238
  Gene Symbol: SAC3D1
  Gene Name: SAC3 domain containing 1
  ENSP ID: ENSP00000381824
MPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVLLDLALQGAGDAEAAVVLEAALATLLTVVARLGPDAARGPADPVLLQAQVQEGFGSLRRCYARGAGPHPRQPAFQGLFLLYNLGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 76319 - protein, 358 aa, Homo sapiens; identical to SEQ ID NO: 76318
  Payload ID: 15238
  Gene Symbol: SAC3D1
  Gene Name: SAC3 domain containing 1
  ENSP ID: ENSP00000436649

SEQ ID NO: 76320 - protein, 239 aa, Homo sapiens
  Payload ID: 15238
  Gene Symbol: SAC3D1
  Gene Name: SAC3 domain containing 1
  ENSP ID: ENSP00000436704
CRPRDAERPPSPRSPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVLLDLALQGAGDAEAAVVLEAALATLLTVVARLGPDAARGPADPVLLQAQVQEGFGSLRRCYARGAGPHPRQPAFQGLFLLYNLEMGSRMLPLEFLGSSDPPAPPSQVAGCGHHAQ

SEQ ID NO: 76321 - protein, 404 aa, Homo sapiens
  Payload ID: 15238
  Gene Symbol: SAC3D1
  Gene Name: SAC3 domain containing 1
  Uniprot ID: A6NKF1
  ENSP ID: ENSP00000482039
MAGRRAQTGSAPPRPAAPHPRPASRAFPQHCRPRDAERPPSPRSPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVLLDLALQGAGDAEAAVVLEAALATLLTVVARLGPDAARGPADPVLLQAQVQEGFGSLRRCYARGAGPHPRQPAFQGLFLLYNLGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 76322 - protein, 429 aa, Homo sapiens
  Payload ID: 15239
  Gene Symbol: SCCPDH
  Gene Name: saccharopine dehydrogenase (putative)
  Uniprot ID: Q8NBX0
  ENSP ID: ENSP00000355467
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 76323 - protein, 4579 aa, Homo sapiens
  Payload ID: 15240
  Gene Symbol: SACS
  Gene Name: sacsin molecular chaperone
  Uniprot ID: Q9NZJ4
  ENSP ID: ENSP00000371729
METKENRWVPVTVLPGCVGCRTVAALASWTVRDVKERIFAETGFPVSEQRLWRGGRELSDWIKIGDLTSKNCHLFVNLQSKGLKGGGRFGQTTPPLVDFLKDILRRYPEGGQILKELIQNAEDAGATEVKFLYDETQYGTETLWSKDMAPYQGPALYVYNNAVFTPEDWHGIQEIARSRKKDDPLKVGRFGIGFNSVYHITDVPCIFSGDQIGMLDPHQTLFGPHESGQCWNLKDDSKEISELSDQFAPFVGIFGSTKETFINGNFPGTFFRFPLRLQPSQLSSNLYNKQKVLELFESFRADADTVLLFLKSVQDVSLYVREADGTEKLVFRVTSSESKALKHERPNSIKILGTAISNYCKKTPSNNITCVTYHVNIVLEEESTKDAQKTSWLVCNSVGGRGISSKLDSLADELKFVPIIGIAMPLSSRDDEAKGATSDFSGKAFCFLPLPPGEESSTGLPVHISGFFGLTDNRRSIKWRELDQWRDPAALWNEFLVMNVVPKAYATLILDSIKRLEMEKSSDFPLSVDVIYKLWPEASKVKVHWQPVLEPLFSELLQNAVIYSISCDWVRLEQVYFSELDENLEYTKTVLNYLQSSGKQIAKVPGNVDAAVQLTAASGTTPVRKVTPAWVRQVLRKCAHLGCAEEKLHLLEFVLSDQAYSELLGLELLPLQNGNFVPFSSSVSDQDVIYITSAEYPRSLFPSLEGRFILDNLKPHLVAALKEAAQTRGRPCTQLQLLNPERFARLIKEVMNTFWPGRELIVQWYPFDENRNHPSVSWLKMVWKNLYIHFSEDLTLFDEMPLIPRTILEEGQTCVELIRLRIPSLVILDDESEAQLPEFLADIVQKLGGFVLKKLDASIQHPLIKKYIHSPLPSAVLQIMEKMPLQKLCNQITSLLPTHKDALRKFLASLTDSSEKEKRIIQELAIFKRINHSSDQGISSYTKLKGCKVLHHTAKLPADLRLSISVIDSSDEATIRLANMLKIEQLKTTSCLKLVLKDIENAFYSHEEVTQLMLWVLENLSSLKNENPNVLEWLTPLKFIQISQEQMVSAGELFDPDIEVLKDLFCNEEGTYFPPSVFTSPDILHSLRQIGLKNEASLKEKDVVQVAKKIEALQVGACPDQDVLLKKAKTLLLVLNKNHTLLQSSEGKMTLKKIKWVPACKERPPNYPGSLVWKGDLCNLCAPPDMCDVGHAILIGSSLPLVESIHVNLEKALGIFTKPSLSAVLKHFKIVVDWYSSKTFSDEDYYQFQHILLEIYGFMHDHLNEGKDSFRALKFPWVWTGKKFCPLAQAVIKPIHDLDLQPYLHNVPKTMAKFHQLFKVCGSIEELTSDHISMVIQKIYLKSDQDLSEQESKQNLHLMLNIIRWLYSNQIPASPNTPVPIHHSKNPSKLIMKPIHECCYCDIKVDDLNDLLEDSVEPIILVHEDIPMKTAEWLKVPCLSTRLINPENMGFEQSGQREPLTVRIKNILEEYPSVSDIFKELLQNADDANATECSFLIDMRRNMDIRENLLDPGMAACHGPALWSFNNSQFSDSDFVNITRLGESLKRGEVDKVGKFGLGFNSVYHITDIPIIMSREFMIMFDPNINHISKHIKDKSNPGIKINWSKQQKRLRKFPNQFKPFIDVFGCQLPLTVEAPYSYNGTLFRLSFRTQQEAKVSEVSSTCYNTADIYSLVDEFSLCGHRLIIFTQSVKSMYLKYLKIEETNPSLAQDTVIIKKKSCSSKALNTPVLSVLKEAAKLMKTCSSSNKKLPSDEPKSSCILQITVEEFHHVFRRIADLQSPLFRGPDDDPAALFEMAKSGQSKKPSDELSQKTVECTTWLLCTCMDTGEALKFSLSESGRRLGLVPCGAVGVQLSEIQDQKWTVKPHIGEVFCYLPLRIKTGLPVHINGCFAVTSNRKEIWKTDTKGRWNTTFMRHVIVKAYLQVLSVLRDLATSGELMDYTYYAVWPDPDLVHDDFSVICQGFYEDIAHGKGKELTKVFSDGSTWVSMKNVRFLDDSILKRRDVGSAAFKIFLKYLKKTGSKNLCAVELPSSVKLGFEEAGCKQILLENTFSEKQFFSEVFFPNIQEIEAELRDPLMIFVLNEKVDEFSGVLRVTPCIPCSLEGHPLVLPSRLIHPEGRVAKLFDIKDGRFPYGSTQDYLNPIILIKLVQLGMAKDDILWDDMLERAVSVAEINKSDHVAACLRSSILLSLIDEKLKIRDPRAKDFAAKYQTIRFLPFLTKPAGFSLDWKGNSFKPETMFAATDLYTAEHQDIVCLLQPILNENSHSFRGCGSVSLAVKEFLGLLKKPTVDLVINQLKEVAKSVDDGITLYQENITNACYKYLHEALMQNEITKMSIIDKLKPFSFILVENAYVDSEKVSFHLNFEAAPYLYQLPNKYKNNFRELFETVGVRQSCTVEDFALVLESIDQERGTKQITEENFQLCRRIISEGIWSLIREKKQEFCEKNYGKILLPDTNLMLLPAKSLCYNDCPWIKVKDTTVKYCHADIPREVAVKLGAVPKRHKALERYASNVCFTTLGTEFGQKEKLTSRIKSILNAYPSEKEMLKELLQNADDAKATEICFVFDPRQHPVDRIFDDKWAPLQGPALCVYNNQPFTEDDVRGIQNLGKGTKEGNPYKTGQYGIGFNSVYHITDCPSFISGNDILCIFDPHARYAPGATSISPGRMFRDLDADFRTQFSDVLDLYLGTHFKLDNCTMFRFPLRNAEMAKVSEISSVPASDRMVQNLLDKLRSDGAELLMFLNHMEKISICEIDKSTGALNVLYSVKGKITDGDRLKRKQFHASVIDSVTKKRQLKDIPVQQITYTMDTEDSEGNLTTWLICNRSGFSSMEKVSKSVISAHKNQDITLFPRGGVAACITHNYKKPHRAFCFLPLSLETGLPFHVNGHFALDSARRNLWRDDNGVGVRSDWNNSLMTALIAPAYVELLIQLKKRYFPGSDPTLSVLQNTPIHVVKDTLKKFLSFFPVNRLDLQPDLYCLVKALYNCIHEDMKRLLPVVRAPNIDGSDLHSAVIITWINMSTSNKTRPFFDNLLQDELQHLKNADYNITTRKTVAENVYRLKHLLLEIGFNLVYNCDETANLYHCLIDADIPVSYVTPADIRSFLMTFSSPDTNCHIGKLPCRLQQTNLKLFHSLKLLVDYCFKDAEENEIEVEGLPLLITLDSVLQTFDAKRPKFLTTYHELIPSRKDLFMNTLYLKYSNILLNCKVAKVFDISSFADLLSSVLPREYKTKSCTKWKDNFASESWLKNAWHFISESVSVKEDQEETKPTFDIVVDTLKDWALLPGTKFTVSANQLVVPEGDVLLPLSLMHIAVFPNAQSDKVFHALMKAGCIQLALNKICSKDSAFVPLLSCHTANIESPTSILKALHYMVQTSTFRAEKLVENDFEALLMYFNCNLNHLMSQDDIKILKSLPCYKSISGRYVSIGKFGTCYVLTKSIPSAEVEKWTQSSSSAFLEEKIHLKELYEVIGCVPVDDLEVYLKHLLPKIENLSYDAKLEHLIYLKNRLSSAEELSEIKEQLFEKLESLLIIHDANSRLKQAKHFYDRTVRVFEVMLPEKLFIPNDFFKKLEQLIKPKNHVTFMTSWVEFLRNIGLKYILSQQQLLQFAKEISVRANTENWSKETLQNTVDILLHHIFQERMDLLSGNFLKELSLIPFLCPERAPAEFIRFHPQYQEVNGTLPLIKFNGAQVNPKFKQCDVLQLLWTSCPILPEKATPLSIKEQEGSDLGPQEQLEQVLNMLNVNLDPPLDKVINNCRNICNITTLDEEMVKTRAKVLRSIYEFLSAEKREFRFQLRGVAFVMVEDGWKLLKPEEVVINLEYESDFKPYLYKLPLELGTFHQLFKHLGTEDIISTKQYVEVLSRIFKNSEGKQLDPNEMRTVKRVVSGLFRSLQNDSVKVRSDLENVRDLALYLPSQDGRLVKSSILVFDDAPHYKSRIQGNIGVQMLVDLSQCYLGKDHGFHTKLIMLFPQKLRPRLLSSILEEQLDEETPKVCQFGALCSLQGRLQLLLSSEQFITGLIRIMKHENDNAFLANEEKAIRLCKALREGLKVSCFEKLQTTLRVKGFNPIPHSRSETFAFLKRFGNAVILLYIQHSDSKDINFLLALAMTLKSATDNLISDTSYLIAMLGCNDIYRIGEKLDSLGVKYDSSEPSKLELPMPGTPIPAEIHYTLLMDPMNVFYPGEYVGYLVDAEGGDIYGSYQPTYTYAIIVQEVEREDADNSSFLGKIYQIDIGYSEYKIVSSLDLYKFSRPEESSQSRDSAPSTPTSPTEFLTPGLRSIPPLFSGRESHKTSSKHQSPKKLKVNSLPEILKEVTSVVEQAWKLPESERKKIIRRLYLKWHPDKNPENHDIANEVFKHLQNEINRLEKQAFLDQNADRASRRTFSTSASRFQSDKYSFQRFYTSWNQEATSHKSERQQQNKEKCPPSAGQTYSQRFFVPPTFKSVGNPVEARRWLRQARANFSAARNDLHKNANEWVCFKCYLSTKLALIAADYAVRGKSDKDVKPTALAQKIEEYSQQLEGLTNDVHTLEAYGVDSLKTRYPDLLPFPQIPNDRFTSEVAMRVMECTACIIIKLENFMQQKV

SEQ ID NO: 76324 - protein, 4579 aa, Homo sapiens; identical to SEQ ID NO: 76323
  Payload ID: 15240
  Gene Symbol: SACS
  Gene Name: sacsin molecular chaperone
  Uniprot ID: Q9NZJ4
  ENSP ID: ENSP00000371735

SEQ ID NO: 76325 - protein, 3829 aa, Homo sapiens
  Payload ID: 15240
  Gene Symbol: SACS
  Gene Name: sacsin molecular chaperone
  Uniprot ID: Q9NZJ4
  ENSP ID: ENSP00000385844
MNTFWPGRELIVQWYPFDENRNHPSVSWLKMVWKNLYIHFSEDLTLFDEMPLIPRTILEEGQTCVELIRLRIPSLVILDDESEAQLPEFLADIVQKLGGFVLKKLDASIQHPLIKKYIHSPLPSAVLQIMEKMPLQKLCNQITSLLPTHKDALRKFLASLTDSSEKEKRIIQELAIFKRINHSSDQGISSYTKLKGCKVLHHTAKLPADLRLSISVIDSSDEATIRLANMLKIEQLKTTSCLKLVLKDIENAFYSHEEVTQLMLWVLENLSSLKNENPNVLEWLTPLKFIQISQEQMVSAGELFDPDIEVLKDLFCNEEGTYFPPSVFTSPDILHSLRQIGLKNEASLKEKDVVQVAKKIEALQVGACPDQDVLLKKAKTLLLVLNKNHTLLQSSEGKMTLKKIKWVPACKERPPNYPGSLVWKGDLCNLCAPPDMCDVGHAILIGSSLPLVESIHVNLEKALGIFTKPSLSAVLKHFKIVVDWYSSKTFSDEDYYQFQHILLEIYGFMHDHLNEGKDSFRALKFPWVWTGKKFCPLAQAVIKPIHDLDLQPYLHNVPKTMAKFHQLFKVCGSIEELTSDHISMVIQKIYLKSDQDLSEQESKQNLHLMLNIIRWLYSNQIPASPNTPVPIHHSKNPSKLIMKPIHECCYCDIKVDDLNDLLEDSVEPIILVHEDIPMKTAEWLKVPCLSTRLINPENMGFEQSGQREPLTVRIKNILEEYPSVSDIFKELLQNADDANATECSFLIDMRRNMDIRENLLDPGMAACHGPALWSFNNSQFSDSDFVNITRLGESLKRGEVDKVGKFGLGFNSVYHITDIPIIMSREFMIMFDPNINHISKHIKDKSNPGIKINWSKQQKRLRKFPNQFKPFIDVFGCQLPLTVEAPYSYNGTLFRLSFRTQQEAKVSEVSSTCYNTADIYSLVDEFSLCGHRLIIFTQSVKSMYLKYLKIEETNPSLAQDTVIIKKKSCSSKALNTPVLSVLKEAAKLMKTCSSSNKKLPSDEPKSSCILQITVEEFHHVFRRIADLQSPLFRGPDDDPAALFEMAKSGQSKKPSDELSQKTVECTTWLLCTCMDTGEALKFSLSESGRRLGLVPCGAVGVQLSEIQDQKWTVKPHIGEVFCYLPLRIKTGLPVHINGCFAVTSNRKEIWKTDTKGRWNTTFMRHVIVKAYLQVLSVLRDLATSGELMDYTYYAVWPDPDLVHDDFSVICQGFYEDIAHGKGKELTKVFSDGSTWVSMKNVRFLDDSILKRRDVGSAAFKIFLKYLKKTGSKNLCAVELPSSVKLGFEEAGCKQILLENTFSEKQFFSEVFFPNIQEIEAELRDPLMIFVLNEKVDEFSGVLRVTPCIPCSLEGHPLVLPSRLIHPEGRVAKLFDIKDGRFPYGSTQDYLNPIILIKLVQLGMAKDDILWDDMLERAVSVAEINKSDHVAACLRSSILLSLIDEKLKIRDPRAKDFAAKYQTIRFLPFLTKPAGFSLDWKGNSFKPETMFAATDLYTAEHQDIVCLLQPILNENSHSFRGCGSVSLAVKEFLGLLKKPTVDLVINQLKEVAKSVDDGITLYQENITNACYKYLHEALMQNEITKMSIIDKLKPFSFILVENAYVDSEKVSFHLNFEAAPYLYQLPNKYKNNFRELFETVGVRQSCTVEDFALVLESIDQERGTKQITEENFQLCRRIISEGIWSLIREKKQEFCEKNYGKILLPDTNLMLLPAKSLCYNDCPWIKVKDTTVKYCHADIPREVAVKLGAVPKRHKALERYASNVCFTTLGTEFGQKEKLTSRIKSILNAYPSEKEMLKELLQNADDAKATEICFVFDPRQHPVDRIFDDKWAPLQGPALCVYNNQPFTEDDVRGIQNLGKGTKEGNPYKTGQYGIGFNSVYHITDCPSFISGNDILCIFDPHARYAPGATSISPGRMFRDLDADFRTQFSDVLDLYLGTHFKLDNCTMFRFPLRNAEMAKVSEISSVPASDRMVQNLLDKLRSDGAELLMFLNHMEKISICEIDKSTGALNVLYSVKGKITDGDRLKRKQFHASVIDSVTKKRQLKDIPVQQITYTMDTEDSEGNLTTWLICNRSGFSSMEKVSKSVISAHKNQDITLFPRGGVAACITHNYKKPHRAFCFLPLSLETGLPFHVNGHFALDSARRNLWRDDNGVGVRSDWNNSLMTALIAPAYVELLIQLKKRYFPGSDPTLSVLQNTPIHVVKDTLKKFLSFFPVNRLDLQPDLYCLVKALYNCIHEDMKRLLPVVRAPNIDGSDLHSAVIITWINMSTSNKTRPFFDNLLQDELQHLKNADYNITTRKTVAENVYRLKHLLLEIGFNLVYNCDETANLYHCLIDADIPVSYVTPADIRSFLMTFSSPDTNCHIGKLPCRLQQTNLKLFHSLKLLVDYCFKDAEENEIEVEGLPLLITLDSVLQTFDAKRPKFLTTYHELIPSRKDLFMNTLYLKYSNILLNCKVAKVFDISSFADLLSSVLPREYKTKSCTKWKDNFASESWLKNAWHFISESVSVKEDQEETKPTFDIVVDTLKDWALLPGTKFTVSANQLVVPEGDVLLPLSLMHIAVFPNAQSDKVFHALMKAGCIQLALNKICSKDSAFVPLLSCHTANIESPTSILKALHYMVQTSTFRAEKLVENDFEALLMYFNCNLNHLMSQDDIKILKSLPCYKSISGRYVSIGKFGTCYVLTKSIPSAEVEKWTQSSSSAFLEEKIHLKELYEVIGCVPVDDLEVYLKHLLPKIENLSYDAKLEHLIYLKNRLSSAEELSEIKEQLFEKLESLLIIHDANSRLKQAKHFYDRTVRVFEVMLPEKLFIPNDFFKKLEQLIKPKNHVTFMTSWVEFLRNIGLKYILSQQQLLQFAKEISVRANTENWSKETLQNTVDILLHHIFQERMDLLSGNFLKELSLIPFLCPERAPAEFIRFHPQYQEVNGTLPLIKFNGAQVNPKFKQCDVLQLLWTSCPILPEKATPLSIKEQEGSDLGPQEQLEQVLNMLNVNLDPPLDKVINNCRNICNITTLDEEMVKTRAKVLRSIYEFLSAEKREFRFQLRGVAFVMVEDGWKLLKPEEVVINLEYESDFKPYLYKLPLELGTFHQLFKHLGTEDIISTKQYVEVLSRIFKNSEGKQLDPNEMRTVKRVVSGLFRSLQNDSVKVRSDLENVRDLALYLPSQDGRLVKSSILVFDDAPHYKSRIQGNIGVQMLVDLSQCYLGKDHGFHTKLIMLFPQKLRPRLLSSILEEQLDEETPKVCQFGALCSLQGRLQLLLSSEQFITGLIRIMKHENDNAFLANEEKAIRLCKALREGLKVSCFEKLQTTLRVKGFNPIPHSRSETFAFLKRFGNAVILLYIQHSDSKDINFLLALAMTLKSATDNLISDTSYLIAMLGCNDIYRIGEKLDSLGVKYDSSEPSKLELPMPGTPIPAEIHYTLLMDPMNVFYPGEYVGYLVDAEGGDIYGSYQPTYTYAIIVQEVEREDADNSSFLGKIYQIDIGYSEYKIVSSLDLYKFSRPEESSQSRDSAPSTPTSPTEFLTPGLRSIPPLFSGRESHKTSSKHQSPKKLKVNSLPEILKEVTSVVEQAWKLPESERKKIIRRLYLKWHPDKNPENHDIANEVFKHLQNEINRLEKQAFLDQNADRASRRTFSTSASRFQSDKYSFQRFYTSWNQEATSHKSERQQQNKEKCPPSAGQTYSQRFFVPPTFKSVGNPVEARRWLRQARANFSAARNDLHKNANEWVCFKCYLSTKLALIAADYAVRGKSDKDVKPTALAQKIEEYSQQLEGLTNDVHTLEAYGVDSLKTRYPDLLPFPQIPNDRFTSEVAMRVMECTACIIIKLENFMQQKV

SEQ ID NO: 76326 - protein, 374 aa, Homo sapiens
  Payload ID: 15240
  Gene Symbol: SACS
  Gene Name: sacsin molecular chaperone
  ENSP ID: ENSP00000390925
IVLEEESTKDAQKTSWLVCNSVGGRGISSKLDSLADELKFVPIIGIAMPLSSRDDEAKGATSDFSGKAFCFLPLPPGEESSTGLPVHISGFFGLTDNRRSIKWRELDQWRDPAALWNEFLVMNVVPKAYATLILDSIKRLEMEKSSDFPLSVDVIYKLWPEASKVKVHWQPVLEPLFSELLQNAVIYSISCDWVRLEQVYFSELDENLEYTKTVLNYLQSSGKQIAKVPGNVDAAVQLTAASGTTPVRKVTPAWVRQVLRKCAHLGCAEEKLHLLEFVLSDQAYSELLGLELLPLQNGNFVPFSSSVSDQDVIYITSAEYPRSLFPSLEGRFILDNLKPHLVAALKEAAQTRGFLFDEDSNGKLKMVAVLITSC

SEQ ID NO: 76327 - protein, 732 aa, Homo sapiens
  Payload ID: 15240
  Gene Symbol: SACS
  Gene Name: sacsin molecular chaperone
  ENSP ID: ENSP00000406565
  MOD_RES (1)..(1): Any amino acid
XDILRRYPEGGQILKELIQNAEDAGATEVKFLYDETQYGTETLWSKDMAPYQGPALYVYNNAVFTPEDWHGIQEIARSRKKDDPLKVGRFGIGFNSVYHITDVPCIFSGDQIGMLDPHQTLFGPHESGQCWNLKDDSKEISELSDQFAPFVGIFGSTKETFINGNFPGTFFRFPLRLQPSQLSSNLYNKQKVLELFESFRADADTVLLFLKSVQDVSLYVREADGTEKLVFRVTSSESKALKHERPNSIKILGTAISNYCKKTPSNNITCVTYHVNIVLEEESTKDAQKTSWLVCNSVGGRGISSKLDSLADELKFVPIIGIAMPLSSRDDEAKGATSDFSGKAFCFLPLPPGEESSTGLPVHISGFFGLTDNRRSIKWRELDQWRDPAALWNEFLVMNVVPKAYATLILDSIKRLEMEKSSDFPLSVDVIYKLWPEASKVKVHWQPVLEPLFSELLQNAVIYSISCDWVRLEQVYFSELDENLEYTKTVLNYLQSSGKQIAKVPGNVDAAVQLTAASGTTPVRKVTPAWVRQVLRKCAHLGCAEEKLHLLEFVLSDQAYSELLGLELLPLQNGNFVPFSSSVSDQDVIYITSAEYPRSLFPSLEGRFILDNLKPHLVAALKEAAQTRGRPCTQLQLLNPERFARLIKEVMNTFWPGRELIVQWYPFDENRNHPSVSWLKMVWKNLYIHFSEDLTLFDEMPLIPRTILEEGFLFDEDSNGKLKMVAVLITSC

SEQ ID NO: 76328 - protein, 702 aa, Homo sapiens
  Payload ID: 15241
  Gene Symbol: SUN1
  Gene Name: Sad1 and UNC84 domain containing 1
  Uniprot ID: O94901
  ENSP ID: ENSP00000374225
MSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKWKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 76329 - protein, 257 aa, Homo sapiens
  Payload ID: 15241
  Gene Symbol: SUN1
  Gene Name: Sad1 and UNC84 domain containing 1
  Uniprot ID: O94901
  ENSP ID: ENSP00000383947
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCKSQSFKTQKKVCFPNLIFPFCKSQCLHYLSWRLKIIP

SEQ ID NO: 76330 - protein, 785 aa, Homo sapiens
  Payload ID: 15241
  Gene Symbol: SUN1
  Gene Name: Sad1 and UNC84 domain containing 1
  Uniprot ID: O94901
  ENSP ID: ENSP00000384015
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 76331 - protein, 822 aa, Homo sapiens
  Payload ID: 15241
  Gene Symbol: SUN1
  Gene Name: Sad1 and UNC84 domain containing 1
  ENSP ID: ENSP00000384116
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 76332 - protein, 174 aa, Homo sapiens
  Payload ID: 15241
  Gene Symbol: SUN1
  Gene Name: Sad1 and UNC84 domain containing 1
  ENSP ID: ENSP00000388430
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGA

SEQ ID NO: 76333 - protein, 702 aa, Homo sapiens; identical to SEQ ID NO: 76328
  Payload ID: 15241
  Gene Symbol: SUN1
  Gene Name: Sad1 and UNC84 domain containing 1
  Uniprot ID: O94901
  ENSP ID: ENSP00000392309

SEQ ID NO: 76334 - protein, 171 aa, Homo sapiens
  Payload ID: 15241
  Gene Symbol: SUN1
  Gene Name: Sad1 and UNC84 domain containing 1
  ENSP ID: ENSP00000392595
SSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGKAASGVFWWLGIGWYQFVTLISWLNVFLLTRCLRNICKFLVLLIP

SEQ ID NO: 76335 - protein, 113 aa, Homo sapiens
  Payload ID: 15241
  Gene Symbol: SUN1
  Gene Name: Sad1 and UNC84 domain containing 1
  ENSP ID: ENSP00000394381
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTS

SEQ ID NO: 76336 - protein, 88 aa, Homo sapiens
  Payload ID: 15241
  Gene Symbol: SUN1
  Gene Name: Sad1 and UNC84 domain containing 1
  ENSP ID: ENSP00000394597
MDFSRLHMYSPPQCVPENTGYTYALSSSYSSDALDFETEHKLDPVFDSPRMSRRSLRLATTACTLGDGEAVGADSGTSSAVSLKNRAA

SEQ ID NO: 76337 - protein, 278 aa, Homo sapiens
  Payload ID: 15241
  Gene Symbol: SUN1
  Gene Name: Sad1 and UNC84 domain containing 1
  Uniprot ID: O94901
  ENSP ID: ENSP00000395952
MGRISPGSPGLPRTVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCKSQSFKTQKKVCFPNLIFPFCKSQCLHYLSWRLKIIP

SEQ ID NO: 76338 - protein, 88 aa, Homo sapiens; identical to SEQ ID NO: 76336
  Payload ID: 15241
  Gene Symbol: SUN1
  Gene Name: Sad1 and UNC84 domain containing 1
  ENSP ID: ENSP00000399549

SEQ ID NO: 76339 - protein, 118 aa, Homo sapiens
  Payload ID: 15241
  Gene Symbol: SUN1
  Gene Name: Sad1 and UNC84 domain containing 1
  ENSP ID: ENSP00000404965
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSH

SEQ ID NO: 76340 - protein, 427 aa, Homo sapiens
  Payload ID: 15241
  Gene Symbol: SUN1
  Gene Name: Sad1 and UNC84 domain containing 1
  ENSP ID: ENSP00000406444
  MOD_RES (1)..(1): Any amino acid
XKAASGVFWWLGIGWYQFVTLISWLNVFLLTRCLRNICKFLVLLIPLFLLLGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPREAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQVHVPEQAHGGPGAHVLGSPALLQPWPAKQCSRLVHAGPGVPGEGGSGGG

SEQ ID NO: 76341 - protein, 634 aa, Homo sapiens
  Payload ID: 15241
  Gene Symbol: SUN1
  Gene Name: Sad1 and UNC84 domain containing 1
  ENSP ID: ENSP00000406653
  MOD_RES (1)..(1): Any amino acid
XSKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 76342 - protein, 710 aa, Homo sapiens
  Payload ID: 15241
  Gene Symbol: SUN1
  Gene Name: Sad1 and UNC84 domain containing 1
  ENSP ID: ENSP00000409909
GDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 76343 - protein, 135 aa, Homo sapiens
  Payload ID: 15241
  Gene Symbol: SUN1
  Gene Name: Sad1 and UNC84 domain containing 1
  ENSP ID: ENSP00000413188
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVL

SEQ ID NO: 76344 - protein, 682 aa, Homo sapiens
  Payload ID: 15241
  Gene Symbol: SUN1
  Gene Name: Sad1 and UNC84 domain containing 1
  Uniprot ID: O94901
  ENSP ID: ENSP00000413439
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGKAASGVFWWLGIGWYQFVTLISWLNVFLLTRCLRNICKFLVLLIPLFLLLGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 76345 - protein, 158 aa, Homo sapiens
  Payload ID: 15241
  Gene Symbol: SUN1
  Gene Name: Sad1 and UNC84 domain containing 1
  ENSP ID: ENSP00000414279
  MOD_RES (1)..(1): Any amino acid
XGNKAAIQGNGDVGAAAATAHNGFSCSNCSMLSERKDVLTAHPAAPGPVSRVYSRDRNQKSHASYYGRMNVREVLREDGHLSVNGEALCDDCKGKRHLDAHTAAHSQSPRLPGRAGTLWHIWACAGYFLLQILRRIGAVGQAVSRTAWSALWLAVVAP

SEQ ID NO: 76346 - protein, 717 aa, Homo sapiens
  Payload ID: 15242
  Gene Symbol: SUN2
  Gene Name: Sad1 and UNC84 domain containing 2
  Uniprot ID: Q9UH99
  ENSP ID: ENSP00000383992
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 76347 - protein, 738 aa, Homo sapiens
  Payload ID: 15242
  Gene Symbol: SUN2
  Gene Name: Sad1 and UNC84 domain containing 2
  Uniprot ID: Q9UH99
  ENSP ID: ENSP00000385616
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVEDSEGRGSKVTETEPVSSFPAGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 76348 - protein, 717 aa, Homo sapiens; identical to SEQ ID NO: 76346
  Payload ID: 15242
  Gene Symbol: SUN2
  Gene Name: Sad1 and UNC84 domain containing 2
  Uniprot ID: Q9UH99
  ENSP ID: ENSP00000385740

SEQ ID NO: 76349 - protein, 198 aa, Homo sapiens
  Payload ID: 15242
  Gene Symbol: SUN2
  Gene Name: Sad1 and UNC84 domain containing 2
  ENSP ID: ENSP00000390154
VHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQVRDAAVLAEVAQTPHPGSRCSLGTYPARHGVQRGKPCSPFPQLKM

SEQ ID NO: 76350 - protein, 100 aa, Homo sapiens
  Payload ID: 15242
  Gene Symbol: SUN2
  Gene Name: Sad1 and UNC84 domain containing 2
  ENSP ID: ENSP00000393271
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLR

SEQ ID NO: 76351 - protein, 143 aa, Homo sapiens
  Payload ID: 15242
  Gene Symbol: SUN2
  Gene Name: Sad1 and UNC84 domain containing 2
  ENSP ID: ENSP00000403694
  MOD_RES (1)..(1): Any amino acid
XDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAGFQERTKATRPLRP

SEQ ID NO: 76352 - protein, 224 aa, Homo sapiens
  Payload ID: 15242
  Gene Symbol: SUN2
  Gene Name: Sad1 and UNC84 domain containing 2
  ENSP ID: ENSP00000406941
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHF

SEQ ID NO: 76353 - protein, 127 aa, Homo sapiens
  Payload ID: 15242
  Gene Symbol: SUN2
  Gene Name: Sad1 and UNC84 domain containing 2
  ENSP ID: ENSP00000408834
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGYSDVDQQSSSSRLRSAVSRAGSLLWMVATSP

SEQ ID NO: 76354 - protein, 110 aa, Homo sapiens
  Payload ID: 15242
  Gene Symbol: SUN2
  Gene Name: Sad1 and UNC84 domain containing 2
  ENSP ID: ENSP00000411615
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGS

SEQ ID NO: 76355 - protein, 124 aa, Homo sapiens
  Payload ID: 15242
  Gene Symbol: SUN2
  Gene Name: Sad1 and UNC84 domain containing 2
  ENSP ID: ENSP00000412928
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWDPTFQKLLEAQKSPWFFPAQVRTCGCGGG

SEQ ID NO: 76356 - protein, 144 aa, Homo sapiens
  Payload ID: 15242
  Gene Symbol: SUN2
  Gene Name: Sad1 and UNC84 domain containing 2
  ENSP ID: ENSP00000414950
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGRR

SEQ ID NO: 76357 - protein, 228 aa, Homo sapiens
  Payload ID: 15242
  Gene Symbol: SUN2
  Gene Name: Sad1 and UNC84 domain containing 2
  ENSP ID: ENSP00000415588
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTRRFSSLKTFLWFLLPLLLLTCLTY

SEQ ID NO: 76358 - protein, 357 aa, Homo sapiens
  Payload ID: 15243
  Gene Symbol: SUN3
  Gene Name: Sad1 and UNC84 domain containing 3
  Uniprot ID: Q8TAQ9
  ENSP ID: ENSP00000297325
MSGKTKARRAAMFFRRCSEDASGSASGNALLSEDENPDANGVTRSWKIILSTMLTLTFLLVGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 76359 - protein, 357 aa, Homo sapiens; identical to SEQ ID NO: 76358
  Payload ID: 15243
  Gene Symbol: SUN3
  Gene Name: Sad1 and UNC84 domain containing 3
  Uniprot ID: Q8TAQ9
  ENSP ID: ENSP00000378939

SEQ ID NO: 76360 - protein, 266 aa, Homo sapiens [sequence omitted]

SEQ ID NO: 76361 - protein, 281 aa, Homo sapiens
  Payload ID: 15243
  Gene Symbol: SUN3
  Gene Name: Sad1 and UNC84 domain containing 3
  ENSP ID: ENSP00000388627
  MOD_RES (1)..(1): Any amino acid
XYAIIAEYGSRLYKYQARLRMPKEQLELLKKESQNLENNFRQILFLIEQIDVLKALLRDMKDGMDNNHNWNTHGDPVEDPDHTEVLDEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 76362 - protein, 89 aa, Homo sapiens
  Payload ID: 15243
  Gene Symbol: SUN3
  Gene Name: Sad1 and UNC84 domain containing 3
  ENSP ID: ENSP00000395392
MSGKTKARRAAMFFRRCSEDASGSASGNALLSEDENPDANGVTRSWKIILSTMLTLTFLLVGWSAVVRSWLTATSTSWVQAFLLPQPPE

SEQ ID NO: 76363 - protein, 170 aa, Homo sapiens
  Payload ID: 15243
  Gene Symbol: SUN3
  Gene Name: Sad1 and UNC84 domain containing 3
  ENSP ID: ENSP00000406887
EDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQGPWHTRQAHLEELVQKAMPHVQNIQECLFS

SEQ ID NO: 76364 - protein, 269 aa, Homo sapiens
  Payload ID: 15243
  Gene Symbol: SUN3
  Gene Name: Sad1 and UNC84 domain containing 3
  Uniprot ID: Q8TAQ9
  ENSP ID: ENSP00000409077
MPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYVQRYMCRFVIQAGITKKCEGEEIFLGQFIYNKTGTTVQTFELQHAVSEYLLCVKLNIFSNWGHPKYTCLYRFRVHGTPGKHI

SEQ ID NO: 76365 - protein, 345 aa, Homo sapiens
  Payload ID: 15243
  Gene Symbol: SUN3
  Gene Name: Sad1 and UNC84 domain containing 3
  Uniprot ID: Q8TAQ9
  ENSP ID: ENSP00000410204
MEDYSKYNAYTDFSSCRLECSGAILAHCNLHLLGSSISPASASRVAGTTGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 76366 - protein, 379 aa, Homo sapiens
  Payload ID: 15244
  Gene Symbol: SUN5
  Gene Name: Sad1 and UNC84 domain containing 5
  Uniprot ID: Q8TC36
  ENSP ID: ENSP00000348496
MPRSSRSPGDPGALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGFWMFSIHLPSKMKVWQDDSINGPLQSLRLYQEKVRHHSGEIQDLRGSMNQLIAKLQEMEAMSDEQKMAQKIMKMIHGDYIEKPDFALKSIGASIDFEHTSVTYNHEKAHSYWNWIQLWNYAQPPDVILEPNVTPGNCWAFEGDRGQVTIQLAQKVYLSNLTLQHIPKTISLSGSLDTAPKDFVIYGMEGSPKEEVFLGAFQFQPENIIQMFPLQNQPARAFSAVKVKISSNWGNPGFTCLYRVRVHGSVAPPREQPHQNPYPKRD

SEQ ID NO: 76367 - protein, 122 aa, Homo sapiens
  Payload ID: 15244
  Gene Symbol: SUN5
  Gene Name: Sad1 and UNC84 domain containing 5
  ENSP ID: ENSP00000364669
MPRSSRSPGDPGALLEDVAHNPRPRRIAQRGRNTSRMAEDTSPNMNDNILLPVRNNDQALGLTQCMLGCVYASCCARSSWRRQAFCSSVLSVCPRALPSPRWRYPWALALIIGHWARHCTAT

SEQ ID NO: 76368 - protein, 354 aa, Homo sapiens
  Payload ID: 15244
  Gene Symbol: SUN5
  Gene Name: Sad1 and UNC84 domain containing 5
  ENSP ID: ENSP00000364673
MPRSSRSPGDPGALLEDVAHNPRPRRIAQRGRNTSRMAEDTSPNMTWFTCFACSLRTQAQQVLFNTCRCKLLCQKLMEKTGILLLCAFGFWMFSIHLPSKMKVWQDDSINGPLQSLRLYQEKVRHHSGEIQDLRGSMNQLIAKLQEMEAMSDEQKMAQKIMKMIHGDYIEKPDFALKSIGASIDFEHTSVTYNHEKAHSYWNWIQLWNYAQPPDVILEPNVTPGNCWAFEGDRGQVTIQLAQKVYLSNLTLQHIPKTISLSGSLDTAPKDFVIYGMEGSPKEEVFLGAFQFQPENIIQMFPLQNQPARAFSAVKVKISSNWGNPGFTCLYRVRVHGSVAPPREQPHQNPYPKRD

SEQ ID NO: 76369 - protein, 152 aa, Homo sapiens
  Payload ID: 15244
  Gene Symbol: SUN5
  Gene Name: Sad1 and UNC84 domain containing 5
  ENSP ID: ENSP00000400089
GALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGVSQGPAQSQVEVSLGPGTDYRTLGKTLHCHVTQFPHLPDGCCCENYEMK

SEQ ID NO: 76370 - protein, 453 aa, Homo sapiens
  Payload ID: 15245
  Gene Symbol: SLTM
  Gene Name: SAFB-like, transcription modulator
  ENSP ID: ENSP00000249736
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKK

SEQ ID NO: 76371 - protein, 1034 aa, Homo sapiens
  Payload ID: 15245
  Gene Symbol: SLTM
  Gene Name: SAFB-like, transcription modulator
  Uniprot ID: Q9NWH9
  ENSP ID: ENSP00000369887
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 76372 - protein, 600 aa, Homo sapiens
  Payload ID: 15245
  Gene Symbol: SLTM
  Gene Name: SAFB-like, transcription modulator
  ENSP ID: ENSP00000411534
GKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 76373 - protein, 100 aa, Homo sapiens
  Payload ID: 15245
  Gene Symbol: SLTM
  Gene Name: SAFB-like, transcription modulator
  ENSP ID: ENSP00000452805
GVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 76374 - protein, 205 aa, Homo sapiens
  Payload ID: 15245
  Gene Symbol: SLTM
  Gene Name: SAFB-like, transcription modulator
  ENSP ID: ENSP00000452945
  MOD_RES (1)..(1): Any amino acid
XDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKALQRNLKTARHHLKMTKEVQVVLVVAVEAQLKISGLVDFHLIPKLLI

SEQ ID NO: 76375 - protein, 229 aa, Homo sapiens
  Payload ID: 15245
  Gene Symbol: SLTM
  Gene Name: SAFB-like, transcription modulator
  ENSP ID: ENSP00000453065
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDSEASKPKDGQDAIAQSPEKESKDYEMNANHKD

SEQ ID NO: 76376 - protein, 192 aa, Homo sapiens
  Payload ID: 15245
  Gene Symbol: SLTM
  Gene Name: SAFB-like, transcription modulator
  ENSP ID: ENSP00000453179
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDGEEEENEKDIAGSGDGTQEVSKPLPSEGSLAEADHTAHEEMEAHTTVKEAEDDNISVTIQAEDAITLDFDGDDLLETGKNVKITDS

SEQ ID NO: 76377 - protein, 62 aa, Homo sapiens
  Payload ID: 15245
  Gene Symbol: SLTM
  Gene Name: SAFB-like, transcription modulator
  ENSP ID: ENSP00000453371
MAAATGAVAASAASGQAEGKKITDLRVIDLKSELKRRNLDITGVKTVLISRLKQVKNMKQMS

SEQ ID NO: 76378 - protein, 111 aa, Homo sapiens
  Payload ID: 15245
  Gene Symbol: SLTM
  Gene Name: SAFB-like, transcription modulator
  ENSP ID: ENSP00000453662
  MOD_RES (1)..(1): Any amino acid
XLRYEQEKRNSLKRPRDVDHSKYFSSRRDDPYWSENKKLSLDTDARFGHGSDYSRQQNRFNDFDHRERGRFPESSAVQSSSFERRDRFVGQSEGKKARPTARREDPSFERY

SEQ ID NO: 76379 - protein, 177 aa, Homo sapiens
  Payload ID: 15245
  Gene Symbol: SLTM
  Gene Name: SAFB-like, transcription modulator
  ENSP ID: ENSP00000453711
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKEIEAQEGEDDTFLTAQDGEEEENEKALQRNLKTARHHLKMTKEVQVVLVVAVEAQLKISGLVDFHLIPKLLI

SEQ ID NO: 76380 - protein, 89 aa, Homo sapiens
  Payload ID: 15245
  Gene Symbol: SLTM
  Gene Name: SAFB-like, transcription modulator
  ENSP ID: ENSP00000453775
MAAATGAVAASAASGQAEGKKITDLRVIDLKSELKRRNLDITGVKTVLISRLKQAIEEEGGDPDNIELTVSTDTPNKKPTKGKDYKLKH

SEQ ID NO: 76381 - protein, 161 aa, Homo sapiens
  Payload ID: 15245
  Gene Symbol: SLTM
  Gene Name: SAFB-like, transcription modulator
  ENSP ID: ENSP00000453987
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKEIEAQEGEDDTFLTAQDGEEEENEKEGSLAEADHTAHEEMEAHTTVKEAEDDNISV

SEQ ID NO: 76382 - protein, 62 aa, Homo sapiens; identical to SEQ ID NO: 76377
  Payload ID: 15245
  Gene Symbol: SLTM
  Gene Name: SAFB-like, transcription modulator
  ENSP ID: ENSP00000454000

SEQ ID NO: 76383 - protein, 62 aa, Homo sapiens; identical to SEQ ID NO: 76377
  Payload ID: 15245
  Gene Symbol: SLTM
  Gene Name: SAFB-like, transcription modulator
  ENSP ID: ENSP00000485870

SEQ ID NO: 76384 - protein, 293 aa, Homo sapiens
  Payload ID: 15246
  Gene Symbol: SGF29
  Gene Name: SAGA complex associated factor 29
  Uniprot ID: Q96ES7
  ENSP ID: ENSP00000316114
MALVSADSRIAELLTELHQLIKQTQEERSRSEHNLVNIQKTHERMQTENKISPYYRTKLRGLYTTAKADAEAECNILRKALDKIAEIKSLLEERRIAAKIAGLYNDSEPPRKTMRRGVLMTLLQQSAMTLPLWIGKPGDKPPPLCGAIPASGDYVARPGDKVAARVKAVDGDEQWILAEVVSYSHATNKYEVDDIDEEGKERHTLSRRRVIPLPQWKANPETDPEALFQKEQLVLALYPQTTCFYRALIHAPPQRPQDDYSVLFEDTSYADGYSPPLNVAQRYVVACKEPKKK

SEQ ID NO: 76385 - protein, 90 aa, Homo sapiens
  Payload ID: 15246
  Gene Symbol: SGF29
  Gene Name: SAGA complex associated factor 29
  ENSP ID: ENSP00000454730
  MOD_RES (1)..(1): Any amino acid
XGDEQWILAEVVSYSHATNKYEALFQKEQLVLALYPQTTCFYRALIHAPPQRPQDDYSVLFEDTSYADGYSPPLNVAQRYVVACKEPKKK

SEQ ID NO: 76386 - protein, 132 aa, Homo sapiens
  Payload ID: 15246
  Gene Symbol: SGF29
  Gene Name: SAGA complex associated factor 29
  ENSP ID: ENSP00000455370
MALVSADSRIAELLTELHQLIKQTQEERSRSEHNLVNIQKTHERMQTENKISPYYRTKLRGLYTTAKADAEAECKLECNDAISVHCNLCLPGSSDSLASASQHPSESSGQDRGNQVSVGREADCGQDCRSLQ

SEQ ID NO: 76387 - protein, 128 aa, Homo sapiens
  Payload ID: 15247
  Gene Symbol: STH
  Gene Name: saitohin
  Uniprot ID: Q8IWL8
  ENSP ID: ENSP00000443168
MSEGGGQVSCIFAAPTRLCRWPALIECGVNLTQPLCEWMIQVARDRTLSLAWEVASLLTLSSSEVGLEGVGTIWPSSYSSEESSRNGAEQGRQLSIEGPFQGQNCPSHPAAALPLPMRGESQATSCQV

SEQ ID NO: 76388 - protein, 128 aa, Homo sapiens
  Payload ID: 15247
  Gene Symbol: STH
  Gene Name: saitohin
  ENSP ID: ENSP00000486737
MSEGGGRVSCIFAAPTRLCRWPALIECGVNLTQPLCEWMIQVARDRTLSLAWEVASLLTLSSSEVGLEGVGTIWPSSYSSEESSRNGAEQGRQLSIEGPFQGQNCPSHPAAALPLPMRGESQATSCQV

SEQ ID NO: 76389 - protein, 783 aa, Homo sapiens
  Payload ID: 15248
  Gene Symbol: SIK1
  Gene Name: salt-inducible kinase 1
  Uniprot ID: P57059
  ENSP ID: ENSP00000270162
MVIMSEFSADPAGQGQGQQKPLRVGFYDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIRRMLVVDPARRITIAQIRQHRWMRAEPCLPGPACPAFSAHSYTSNLGDYDEQALGIMQTLGVDRQRTVESLQNSSYNHFAAIYYLLLERLKEYRNAQCARPGPARQPRPRSSDLSGLEVPQEGLSTDPFRPALLCPQPQTLVQSVLQAEMDCELQSSLQWPLFFPVDASCSGVFRPRPVSPSSLLDTAISEEARQGPGLEEEQDTQESLPSSTGRRHTLAEVSTRLSPLTAPCIVVSPSTTASPAEGTSSDSCLTFSASKSPAGLSGTPATQGLLGACSPVRLASPFLGSQSATPVLQAQGGLGGAVLLPVSFQEGRRASDTSLTQGLKAFRQQLRKTTRTKGFLGLNKIKGLARQVCQAPASRASRGGLSPFHAPAQSPGLHGGAAGSREGWSLLEEVLEQQRLLQLQHHPAAAPGCSQAPQPAPAPFVIAPCDGPGAAPLPSTLLTSGLPLLPPPLLQTGASPVASAAQLLDTHLHIGTGPTALPAVPPPRLARLAPGCEPLGLLQGDCEMEDLMPCSLGTFVLVQ

SEQ ID NO: 76390 - protein, 926 aa, Homo sapiens
  Payload ID: 15249
  Gene Symbol: SIK2
  Gene Name: salt-inducible kinase 2
  Uniprot ID: Q9H0K1
  ENSP ID: ENSP00000305976
MVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPRMTSPFISLRPTNPAMQALSSQKREVHNRSPVSFREGRRASDTSLTQGIVAFRQHLQNLARTKGILELNKVQLLYEQIGPEADPNLAPAAPQLQDLASSCPQEEVSQQQESVSTLPASVHPQLSPRQSLETQYLQHRLQKPSLLSKAQNTCQLYCKEPPRSLEQQLQEHRLQQKRLFLQKQSQLQAYFNQMQIAESSYPQPSQQLPLPRQETPPPSQQAPPFSLTQPLSPVLEPSSEQMQYSPFLSQYQEMQLQPLPSTSGPRAAPPLPTQLQQQQPPPPPPPPPPRQPGAAPAPLQFSYQTCELPSAASPAPDYPTPCQYPVDGAQQSDLTGPDCPRSPGLQEAPSSYDPLALSELPGLFDCEMLDAVDPQHNGYVLVN

SEQ ID NO: 76391 - protein, 383 aa, Homo sapiens
  Payload ID: 15250
  Gene Symbol: SAV1
  Gene Name: salvador family WW domain containing protein 1
  Uniprot ID: Q9H4B6
  ENSP ID: ENSP00000324729
MLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 76392 - protein, 67 aa, Homo sapiens
  Payload ID: 15250
  Gene Symbol: SAV1
  Gene Name: salvador family WW domain containing protein 1
  ENSP ID: ENSP00000450571
VTEVSFAVENGDSGSRYYYSDNFFDGQRKRPLGDRAHEDYRYYEYNHDLFQRMPQNQGRHASDMTTF

SEQ ID NO: 76393 - protein, 312 aa, Homo sapiens
  Payload ID: 15250
  Gene Symbol: SAV1
  Gene Name: salvador family WW domain containing protein 1
  ENSP ID: ENSP00000451492
RNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQCQCCYCI

SEQ ID NO: 76394 - protein, 77 aa, Homo sapiens
  Payload ID: 15250
  Gene Symbol: SAV1
  Gene Name: salvador family WW domain containing protein 1
  ENSP ID: ENSP00000451596
MLSRKKTKNEVSKPAEVQGKYVKKETSPLLRNASRCASCLQTLRVSLDCAASCANSGAEFLSPAAGCRLEKILCLHS

SEQ ID NO: 76395 - protein, 89 aa, Homo sapiens
  Payload ID: 15250
  Gene Symbol: SAV1
  Gene Name: salvador family WW domain containing protein 1
  ENSP ID: ENSP00000452104
  MOD_RES (1)..(1): Any amino acid
XFGTYYVDHTNKKAQYRHPCAPRYDHILKWELFQLADLDTYQGMLKLLFMKELEQIVKMYEAYRQALLTELENRKQRQQWYAQQHGKNF

SEQ ID NO: 76396 - protein, 1247 aa, Homo sapiens
  Payload ID: 15251
  Gene Symbol: SASH1
  Gene Name: SAM and SH3 domain containing 1
  Uniprot ID: O94885
  ENSP ID: ENSP00000356437
MEDAGAAGPGPEPEPEPEPEPEPAPEPEPEPKPGAGTSEAFSRLWTDVMGILDGSLGNIDDLAQQYADYYNTCFSDVCERMEELRKRRVSQDLEVEKPDASPTSLQLRSQIEESLGFCSAVSTPEVERKNPLHKSNSEDSSVGKGDWKKKNKYFWQNFRKNQKGIMRQTSKGEDVGYVASEITMSDEERIQLMMMVKEKMITIEEALARLKEYEAQHRQSAALDPADWPDGSYPTFDGSSNCNSREQSDDETEESVKFKRLHKLVNSTRRVRKKLIRVEEMKKPSTEGGEEHVFENSPVLDERSALYSGVHKKPLFFDGSPEKPPEDDSDSLTTSPSSSSLDTWGAGRKLVKTFSKGESRGLIKPPKKMGTFFSYPEEEKAQKVSRSLTEGEMKKGLGSLSHGRTCSFGGFDLTNRSLHVGSNNSDPMGKEGDFVYKEVIKSPTASRISLGKKVKSVKETMRKRMSKKYSSSVSEQDSGLDGMPGSPPPSQPDPEHLDKPKLKAGGSVESLRSSLSGQSSMSGQTVSTTDSSTSNRESVKSEDGDDEEPPYRGPFCGRARVHTDFTPSPYDTDSLKLKKGDIIDIISKPPMGTWMGLLNNKVGTFKFIYVDVLSEDEEKPKRPTRRRRKGRPPQPKSVEDLLDRINLKEHMPTFLFNGYEDLDTFKLLEEEDLDELNIRDPEHRAVLLTAVELLQEYDSNSDQSGSQEKLLVDSQGLSGCSPRDSGCYESSENLENGKTRKASLLSAKSSTEPSLKSFSRNQLGNYPTLPLMKSGDALKQGQEEGRLGGGLAPDTSKSCDPPGVTGLNKNRRSLPVSICRSCETLEGPQTVDTWPRSHSLDDLQVEPGAEQDVPTEVTEPPPQIVPEVPQKTTASSTKAQPLEQDSAVDNALLLTQSKRFSEPQKLTTKKLEGSIAASGRGLSPPQCLPRNYDAQPPGAKHGLARTPLEGHRKGHEFEGTHHPLGTKEGVDAEQRMQPKIPSQPPPVPAKKSRERLANGLHPVPMGPSGALPSPDAPCLPVKRGSPASPTSPSDCPPALAPRPLSGQAPGSPPSTRPPPWLSELPENTSLQEHGVKLGPALTRKVSCARGVDLETLTENKLHAEGIDLTEEPYSDKHGRCGIPEALVQRYAEDLDQPERDVAANMDQIRVKQLRKQHRMAIPSGGLTEICRKPVSPGCISSVSDWLISIGLPMYAGTLSTAGFSTLSQVPSLSHTCLQEAGITEERHIRKLLSAARLFKLPPGPEAM

SEQ ID NO: 76397 - protein, 84 aa, Homo sapiens
  Payload ID: 15251
  Gene Symbol: SASH1
  Gene Name: SAM and SH3 domain containing 1
  ENSP ID: ENSP00000356439
MEEQDCRDGSLGNIDDLAQQYADYYNTCFSDVCERMEELRKRRVSQDLEVEKPDASPTSLQLRSQIEESLGFCSAVSTPEVERK

SEQ ID NO: 76398 - protein, 657 aa, Homo sapiens
  Payload ID: 15251
  Gene Symbol: SASH1
  Gene Name: SAM and SH3 domain containing 1
  ENSP ID: ENSP00000479998
MGTWMGLLNNKVGTFKFIYVDVLSEDEEKPKRPTRRRRKGRPPQPKSVEDLLDRINLKEHMPTFLFNGYEDLDTFKLLEEEDLDELNIRDPEHRAVLLTAVELLQEYDSNSDQSGSQEKLLVDSQGLSGCSPRDSGCYESSENLENGKTRKASLLSAKSSTEPSLKSFSRNQLGNYPTLPLMKSGDALKQGQEEGRLGGGLAPDTSKSCDPPGVTGLNKNRRSLPVSICRSCETLEGPQTVDTWPRSHSLDDLQVEPGAEQDVPTEVTEPPPQIVPEVPQKTTASSTKAQPLEQDSAVDNALLLTQSKRFSEPQKLTTKKLEGSIAASGRGLSPPQCLPRNYDAQPPGAKHGLARTPLEGHRKGHEFEGTHHPLGTKEGVDAEQRMQPKIPSQPPPVPAKKSRERLANGLHPVPMGPSGALPSPDAPCLPVKRGSPASPTSPSDCPPALAPRPLSGQAPGSPPSTRPPPWLSELPENTSLQEHGVKLGPALTRKVSCARGVDLETLTENKLHAEGIDLTEEPYSDKHGRCGIPEALVQRYAEDLDQPERDVAANMDQIRVKQLRKQHRMAIPSGGLTEICRKPVSPGCISSVSDWLISIGLPMYAGTLSTAGFSTLSQVPSLSHTCLQEAGITEERHIRKLLSAARLFKLPPGPEAM

SEQ ID NO: 76399 - protein, 380 aa, Homo sapiens
  Payload ID: 15252
  Gene Symbol: SASH3
  Gene Name: SAM and SH3 domain containing 3
  Uniprot ID: O75995
  ENSP ID: ENSP00000349359
MLRRKPSNASEKEPTQKKKLSLQRSSSFKDFAKSKPSSPVVSEKEFNLDDNIPEDDSGVPTPEDAGKSGKKLGKKWRAVISRTMNRKMGKMMVKALSEEMADTLEEGSASPTSPDYSLDSPGPEKMALAFSEQEEHELPVLSRQASTGSELCSPSPGSGSFGEEPPAPQYTGPFCGRARVHTDFTPSPYDHDSLKLQKGDVIQIIEKPPVGTWLGLLNGKVGSFKFIYVDVLPEEAVGHARPSRRQSKGKRPKPKTLHELLERIGLEEHTSTLLLNGYQTLEDFKELRETHLNELNIMDPQHRAKLLTAAELLLDYDTGSEEAEEGAESSQEPVAHTVSEPKVDIPRDSGCFEGSESGRDDAELAGTEEQLQGLSLAGAP

SEQ ID NO: 76400 - protein, 626 aa, Homo sapiens
  Payload ID: 15253
  Gene Symbol: SAMHD1
  Gene Name: SAM domain and HD domain 1
  Uniprot ID: Q9Y3Z3
  ENSP ID: ENSP00000262878
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQDGDVIAPLITPQKKEWNDSTSVQNPTRLREASKSRVQLFKDDPM

SEQ ID NO: 76401 - protein, 441 aa, Homo sapiens
  Payload ID: 15254
  Gene Symbol: SAMSN1
  Gene Name: SAM domain, SH3 domain and nuclear localization signals 1
  Uniprot ID: Q9NSI8
  ENSP ID: ENSP00000285670
MEIRLDTLSASLGRSSTLNNCNLEDKLAWYEGEAYMWHHWKPFPENPLWTCLDFQIAQVGPWDHCSSCIRHTRLKSSCSDMDLLHSWRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 76402 - protein, 205 aa, Homo sapiens
  Payload ID: 15254
  Gene Symbol: SAMSN1
  Gene Name: SAM domain, SH3 domain and nuclear localization signals 1
  Uniprot ID: Q9NSI8
  ENSP ID: ENSP00000383409
MLKRKPSNVSEKEKHQKPKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 76403 - protein, 373 aa, Homo sapiens
  Payload ID: 15254
  Gene Symbol: SAMSN1
  Gene Name: SAM domain, SH3 domain and nuclear localization signals 1
  Uniprot ID: Q9NSI8
  ENSP ID: ENSP00000383411
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 76404 - protein, 304 aa, Homo sapiens
  Payload ID: 15254
  Gene Symbol: SAMSN1
  Gene Name: SAM domain, SH3 domain and nuclear localization signals 1
  ENSP ID: ENSP00000480850
MRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 76405 - protein, 335 aa, Homo sapiens
  Payload ID: 15255
  Gene Symbol: SPDEF
  Gene Name: SAM pointed domain containing ETS transcription factor
  Uniprot ID: O95238
  ENSP ID: ENSP00000363149
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 76406 - protein, 319 aa, Homo sapiens
  Payload ID: 15255
  Gene Symbol: SPDEF
  Gene Name: SAM pointed domain containing ETS transcription factor
  Uniprot ID: O95238
  ENSP ID: ENSP00000442715
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 76407 - protein, 469 aa, Homo sapiens
  Payload ID: 15256
  Gene Symbol: SAMM50
  Gene Name: SAMM50 sorting and assembly machinery component
  Uniprot ID: Q9Y512
  ENSP ID: ENSP00000345445
MGTVHARSLEPLPSSGPDFGGLGEEAEFVEVEPEAKQEILENKDVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWSSLRETDRGMSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSIRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 76408 - protein, 405 aa, Homo sapiens
  Payload ID: 15257
  Gene Symbol: SAG
  Gene Name: S-antigen
  retina and pineal gland (arrestin)
  Uniprot ID: P10523
  ENSP ID: ENSP00000386444
MAASGKTSKSEPNHVIFKKISRDKSVTIYLGNRDYIDHVSQVQPVDGVVLVDPDLVKGKKVYVTLTCAFRYGQEDIDVIGLTFRRDLYFSRVQVYPPVGAASTPTKLQESLLKKLGSNTYPFLLTFPDYLPCSVMLQPAPQDSGKSCGVDFEVKAFATDSTDAEEDKIPKKSSVRLLIRKVQHAPLEMGPQPRAEAAWQFFMSDKPLHLAVSLNKEIYFHGEPIPVTVTVTNNTEKTVKKIKAFVEQVANVVLYSSDYYVKPVAMEEAQEKVPPNSTLTKTLTLLPLLANNRERRGIALDGKIKHEDTNLASSTIIKEGIDRTVLGILVSYQIKVKLTVSGFLGELTSSEVATEVPFRLMHPQPEDPAKESYQDANLVFEEFARHNLKDAGEAEEGKRDKNDVDE

SEQ ID NO: 76409 - protein, 35 aa, Homo sapiens
  Payload ID: 15257
  Gene Symbol: SAG
  Gene Name: S-antigen
  retina and pineal gland (arrestin)
  ENSP ID: ENSP00000404733
MAASGKTSKSEPNHVIFKKISRDKSMVSCWLILIL

SEQ ID NO: 76410 - protein, 169 aa, Homo sapiens
  Payload ID: 15257
  Gene Symbol: SAG
  Gene Name: S-antigen
  retina and pineal gland (arrestin)
  ENSP ID: ENSP00000408937
MAASGKTSKSEPNHVIFKKISRDKSVTIYLGNRDYIDHVSQVQPVDGVVLVDPDLVKGKKVYVTLTCAFRYGQEDIDVIGLTFRRDLYFSRVQVYPPVGAASTPTKLQESLLKKLGSNTYPFLLTFPDYLPCSVMLQPAPQDSGKSCGVDFEVKAFATDSTDAEEDKIP

SEQ ID NO: 76411 - protein, 130 aa, Homo sapiens
  Payload ID: 15257
  Gene Symbol: SAG
  Gene Name: S-antigen
  retina and pineal gland (arrestin)
  ENSP ID: ENSP00000409475
MAASGKTSKSEPNHVIFKKISRDKSVTIYLGNRDYIDHVSQVQPVDGVVLVDPDLVKGKKGEMKPLVSGWFLGGVDCSLGGSGKGHLHGRRDRKAEAALLHMEPVPGPLTHTPVPNSRDIGPVDTRAHSL

SEQ ID NO: 76412 - protein, 130 aa, Homo sapiens; identical to SEQ ID NO: 76411
  Payload ID: 15257
  Gene Symbol: SAG
  Gene Name: S-antigen
  retina and pineal gland (arrestin)
  ENSP ID: ENSP00000485836

SEQ ID NO: 76413 - protein, 35 aa, Homo sapiens; identical to SEQ ID NO: 76409
  Payload ID: 15257
  Gene Symbol: SAG
  Gene Name: S-antigen
  retina and pineal gland (arrestin)
  ENSP ID: ENSP00000486299

SEQ ID NO: 76414 - protein, 405 aa, Homo sapiens; identical to SEQ ID NO: 76408
  Payload ID: 15257
  Gene Symbol: SAG
  Gene Name: S-antigen
  retina and pineal gland (arrestin)
  Uniprot ID: P10523
  ENSP ID: ENSP00000486571

SEQ ID NO: 76415 - protein, 169 aa, Homo sapiens; identical to SEQ ID NO: 76410
  Payload ID: 15257
  Gene Symbol: SAG
  Gene Name: S-antigen
  retina and pineal gland (arrestin)
  ENSP ID: ENSP00000487232

SEQ ID NO: 76416 - protein, 210 aa, Homo sapiens
  Payload ID: 15258
  Gene Symbol: SARNP
  Gene Name: SAP domain containing ribonucleoprotein
  Uniprot ID: P82979
  ENSP ID: ENSP00000337632
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEAKKRKRAERFGIA

SEQ ID NO: 76417 - protein, 213 aa, Homo sapiens
  Payload ID: 15258
  Gene Symbol: SARNP
  Gene Name: SAP domain containing ribonucleoprotein
  ENSP ID: ENSP00000447690
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDKLKERAQRFGLNVSSISRKSEDDEKLKKRKERFGIVTSSAGTGTTEDTEVKIYLERFIDLEGKLE

SEQ ID NO: 76418 - protein, 52 aa, Homo sapiens
  Payload ID: 15258
  Gene Symbol: SARNP
  Gene Name: SAP domain containing ribonucleoprotein
  ENSP ID: ENSP00000448455
MATETVELHKLKLAELKQECLARGLETKGIKQDLIHRLQAYLEEHGRRNKAH

SEQ ID NO: 76419 - protein, 210 aa, Homo sapiens; identical to SEQ ID NO: 76416
  Payload ID: 15258
  Gene Symbol: SARNP
  Gene Name: SAP domain containing ribonucleoprotein
  Uniprot ID: P82979
  ENSP ID: ENSP00000449409

SEQ ID NO: 76420 - protein, 235 aa, Homo sapiens
  Payload ID: 15259
  Gene Symbol: SAP30BP
  Gene Name: SAP30 binding protein
  ENSP ID: ENSP00000293208
MAGKKNVLSSLAVYAEDSEPESDGEAGIEAVGSAAEEKGGLVSDAYGEDDFSRLGGDEDGYEEEEDENSRQSDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKACCRDVSAAPGDRSCPSPVRAGTASSWVLSL

SEQ ID NO: 76421 - protein, 292 aa, Homo sapiens
  Payload ID: 15259
  Gene Symbol: SAP30BP
  Gene Name: SAP30 binding protein
  Uniprot ID: Q9UHR5
  ENSP ID: ENSP00000347592
MAGKKNVLSSLAVYAEDSEPESDGEAGIEAVGSAAEEKGGLVSDAYGEDDFSRLGGDEDGYEEEEDENSRQSDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKIEFVTGTKKGTTTNATSTTTTTASTAVADAQKRKSKWDSAIPVTTIAQPTILTTTATLPAVVTVTTSASGSKTTVISAVGTIVKKAKQ

SEQ ID NO: 76422 - protein, 168 aa, Homo sapiens
  Payload ID: 15259
  Gene Symbol: SAP30BP
  Gene Name: SAP30 binding protein
  ENSP ID: ENSP00000446117
MAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPSQGPEN

SEQ ID NO: 76423 - protein, 308 aa, Homo sapiens
  Payload ID: 15259
  Gene Symbol: SAP30BP
  Gene Name: SAP30 binding protein
  Uniprot ID: Q9UHR5
  ENSP ID: ENSP00000462116
MAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKIEFVTGTKKGTTTNATSTTTTTASTAVADAQKRKSKWDSAIPVTTIAQPTILTTTATLPAVVTVTTSASGSKTTVISAVGTIVKKAKQ

SEQ ID NO: 76424 - protein, 109 aa, Homo sapiens
  Payload ID: 15259
  Gene Symbol: SAP30BP
  Gene Name: SAP30 binding protein
  ENSP ID: ENSP00000462133
MSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTK

SEQ ID NO: 76425 - protein, 179 aa, Homo sapiens
  Payload ID: 15259
  Gene Symbol: SAP30BP
  Gene Name: SAP30 binding protein
  ENSP ID: ENSP00000462166
MAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPRICLIPMAGLRTPTMRH

SEQ ID NO: 76426 - protein, 104 aa, Homo sapiens
  Payload ID: 15259
  Gene Symbol: SAP30BP
  Gene Name: SAP30 binding protein
  ENSP ID: ENSP00000462255
  MOD_RES (1)..(1): Any amino acid
XEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQVSMRLGY

SEQ ID NO: 76427 - protein, 36 aa, Homo sapiens
  Payload ID: 15259
  Gene Symbol: SAP30BP
  Gene Name: SAP30 binding protein
  ENSP ID: ENSP00000462825
MAGKKNVLSSLAVYAEDSEPESDGEAGIEAVGSAAG

SEQ ID NO: 76428 - protein, 36 aa, Homo sapiens; identical to SEQ ID NO: 76427
  Payload ID: 15259
  Gene Symbol: SAP30BP
  Gene Name: SAP30 binding protein
  ENSP ID: ENSP00000463261

SEQ ID NO: 76429 - protein, 248 aa, Homo sapiens
  Payload ID: 15259
  Gene Symbol: SAP30BP
  Gene Name: SAP30 binding protein
  ENSP ID: ENSP00000463545
  MOD_RES (1)..(1): Any amino acid
XAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKACCRDVSAAPGDRSCPSPVRAGTASSWV

SEQ ID NO: 76430 - protein, 93 aa, Homo sapiens
  Payload ID: 15259
  Gene Symbol: SAP30BP
  Gene Name: SAP30 binding protein
  ENSP ID: ENSP00000463615
MSPDEIKIPPEPPGRCSNHLQDKIQKLYERKIKEGMDMNYIIQRKKEFRNPSIYEKLIQFCAIDELGTNYPKDMFDPHGWSEDSYYEALAKAQ

SEQ ID NO: 76431 - protein, 325 aa, Homo sapiens
  Payload ID: 15259
  Gene Symbol: SAP30BP
  Gene Name: SAP30 binding protein
  ENSP ID: ENSP00000463758
  MOD_RES (1)..(1): Any amino acid
XEPESDGEAGIEAVGSAAEEKGGLVSDAYGEDDFSRLGGDEDGYEEEEDENSRQSEDDDSETEKPEADDPKEKLGTVTEAPRAQQAHGPACWTQRAEESHSKHDKDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKIEFVTGTKKGTTTNATSTTTTTASTAVADAQKRKSKWDSAIPVTTIAQPTILTTTATLPAVVTVTTSASGSKTTVISAVGTIVKKAKQ

SEQ ID NO: 76432 - protein, 37 aa, Homo sapiens
  Payload ID: 15259
  Gene Symbol: SAP30BP
  Gene Name: SAP30 binding protein
  ENSP ID: ENSP00000464459
MAGKKNVLSSLAVYAEDSEPESDGEAGIEAVGSAAGR

SEQ ID NO: 76433 - protein, 183 aa, Homo sapiens
  Payload ID: 15260
  Gene Symbol: SAP30L
  Gene Name: SAP30-like
  Uniprot ID: Q9HAJ7
  ENSP ID: ENSP00000297109
MNGFSTEEDSREGPPAAPAAAAPGYGQSCCLIEDGERCVRPAGNASFSKRVQKSISQKKLKLDIDKSVRHLYICDFHKNFIQSVRNKRKRKTSDDGGDSPEHDTDIPEVDLFQLQVNTLRRYKRHYKLQTRPGFNKAQLAETVSRHFRNIPVNEKETLAYFIYMVKSNKSRLDQKSEGGKQLE

SEQ ID NO: 76434 - protein, 142 aa, Homo sapiens
  Payload ID: 15260
  Gene Symbol: SAP30L
  Gene Name: SAP30-like
  Uniprot ID: Q9HAJ7
  ENSP ID: ENSP00000390927
MNGFSTEEDSREGPPAAPAAAAPGYGQSCCLIEDGERCVRPAGNASFSKRVQKSISQKKLKLDIDKSVDLFQLQVNTLRRYKRHYKLQTRPGFNKAQLAETVSRHFRNIPVNEKETLAYFIYMVKSNKSRLDQKSEGGKQLE

SEQ ID NO: 76435 - protein, 137 aa, Homo sapiens
  Payload ID: 15260
  Gene Symbol: SAP30L
  Gene Name: SAP30-like
  Uniprot ID: Q9HAJ7
  ENSP ID: ENSP00000416393
MNGFSTEEDSREGPPAAPAAAAPGYGQSCCLIEDGERCVRPAGNASFSKRVQKSISQKKLKLDIDKSLQVNTLRRYKRHYKLQTRPGFNKAQLAETVSRHFRNIPVNEKETLAYFIYMVKSNKSRLDQKSEGGKQLE

SEQ ID NO: 76436 - protein, 473 aa, Homo sapiens
  Payload ID: 15261
  Gene Symbol: SRL
  Gene Name: sarcalumenin
  Uniprot ID: Q86TD4
  ENSP ID: ENSP00000382518
MRALVLLGCLLASLLFSGQAEETEDANEEAPLRDRSHIEKTLMLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKH

SEQ ID NO: 76437 - protein, 431 aa, Homo sapiens
  Payload ID: 15261
  Gene Symbol: SRL
  Gene Name: sarcalumenin
  ENSP ID: ENSP00000440350
MLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKH

SEQ ID NO: 76438 - protein, 486 aa, Homo sapiens
  Payload ID: 15261
  Gene Symbol: SRL
  Gene Name: sarcalumenin
  ENSP ID: ENSP00000461179
MRALVLLGCLLASLLFSGQAELQVSASGGTEDVGNLLENHFSAGDASLEEKERALYADTAPQDKKLLLHYPDGREAESPKKTPASAASAGPDPEASLSNASATESPPPGERDDRDAAGPGEEKNGPPVASALPPGGAKGPVEEEWPEPSSGEGQGEEETGFGLPTEGTASGEAGGQAGGHELPEEVQEVQGDSLVQGAVAGTAEPKAEGASPHSEGDGVGPLNAEAEGSPGPGEEPAVPEGAPDVAAVGGESEPDIDTQASEGTEDQGEPGPAAEASAEPGGAQSVKAGDTEENQSPEMTEEDADEASSEEESGDGSGSEEEGGVPSEEESEEDSGDGASSEEAEGASEEATEPQEAGEPQEAREPQEGGDLQEAEESQEGGDPQEAEEPQEGGAPQEGGEPQEGGDPQEAREPQEAREPQEGAELPEATGTTSHRDRGAQPGPEELNTESMGSETLDMKAEEPEEGHQGEGESHHCCPGRDGGCK

SEQ ID NO: 76439 - protein, 387 aa, Homo sapiens
  Payload ID: 15262
  Gene Symbol: SGCA
  Gene Name: sarcoglycan, alpha (50kDa dystrophin-associated glycoprotein)
  Uniprot ID: Q16586
  ENSP ID: ENSP00000262018
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 76440 - protein, 263 aa, Homo sapiens
  Payload ID: 15262
  Gene Symbol: SGCA
  Gene Name: sarcoglycan, alpha (50kDa dystrophin-associated glycoprotein)
  Uniprot ID: Q16586
  ENSP ID: ENSP00000345522
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTGERLPPRVDSAQVPLILDQH

SEQ ID NO: 76441 - protein, 160 aa, Homo sapiens
  Payload ID: 15262
  Gene Symbol: SGCA
  Gene Name: sarcoglycan, alpha (50kDa dystrophin-associated glycoprotein)
  ENSP ID: ENSP00000422030
  MOD_RES (1)..(1): Any amino acid
XLDRGGRVPLPIEGRKEGVYIKVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 76442 - protein, 61 aa, Homo sapiens
  Payload ID: 15262
  Gene Symbol: SGCA
  Gene Name: sarcoglycan, alpha (50kDa dystrophin-associated glycoprotein)
  ENSP ID: ENSP00000422817
MAETLFWTPLLVVLLAGLGDTEAQQTTLHPLVGRVFVHTLDHETFLSLPEHVGHSLQSGQL

SEQ ID NO: 76443 - protein, 65 aa, Homo sapiens
  Payload ID: 15262
  Gene Symbol: SGCA
  Gene Name: sarcoglycan, alpha (50kDa dystrophin-associated glycoprotein)
  ENSP ID: ENSP00000423168
MAETLFWTPLLVGKLGPCSAGRPRMRGQDLGVFSWQGWGTPRPSRPRYTHLWAVSLCTPWTMRRF

SEQ ID NO: 76444 - protein, 196 aa, Homo sapiens
  Payload ID: 15262
  Gene Symbol: SGCA
  Gene Name: sarcoglycan, alpha (50kDa dystrophin-associated glycoprotein)
  ENSP ID: ENSP00000426104
LRHSSGLLSSWVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTVVPGPALTSSSLLCPHHEWHIPPADSSSWPSWNPGSKQAGRGGGVG

SEQ ID NO: 76445 - protein, 298 aa, Homo sapiens
  Payload ID: 15262
  Gene Symbol: SGCA
  Gene Name: sarcoglycan, alpha (50kDa dystrophin-associated glycoprotein)
  ENSP ID: ENSP00000426571
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLAEERPGYLRHPDGPPLHHPREHRGAAADGGQPRGAPATLHPAHVQCAHR

SEQ ID NO: 76446 - protein, 58 aa, Homo sapiens
  Payload ID: 15262
  Gene Symbol: SGCA
  Gene Name: sarcoglycan, alpha (50kDa dystrophin-associated glycoprotein)
  ENSP ID: ENSP00000426606
  MOD_RES (1)..(1): Any amino acid
XCPTRCPHHLPRPPPGTPRPAPVAPLHPAQPPPPWLPLRLCHPRRSWAPGHSLQSGQL

SEQ ID NO: 76447 - protein, 318 aa, Homo sapiens
  Payload ID: 15263
  Gene Symbol: SGCB
  Gene Name: sarcoglycan, beta (43kDa dystrophin-associated glycoprotein)
  Uniprot ID: Q16585
  ENSP ID: ENSP00000370839
MAAAAAAAAEQQSSNGPVKKSMREKAVERRSVNKEHNSNFKAGYIPIDEDRLHKTGLRGRKGNLAICVIILLFILAVINLIITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 76448 - protein, 100 aa, Homo sapiens
  Payload ID: 15263
  Gene Symbol: SGCB
  Gene Name: sarcoglycan, beta (43kDa dystrophin-associated glycoprotein)
  ENSP ID: ENSP00000421235
  MOD_RES (1)..(1): Any amino acid
XAAAAEQQSSNGPVKKSMREKAVERRSVNKEHNSNFKAGYIPIDEDRLHKTGLRGRKGNLAICVIILLFILAVINLILPGSQARDRRAFSGIPDAYRKKI

SEQ ID NO: 76449 - protein, 93 aa, Homo sapiens
  Payload ID: 15263
  Gene Symbol: SGCB
  Gene Name: sarcoglycan, beta (43kDa dystrophin-associated glycoprotein)
  ENSP ID: ENSP00000425818
QSSNGPVKKSMREKAVERRSVNKEHNSNFKAGYIPIDEDRLHKTGLRGRKGNLAICVIILLFILAVINLILPGSQARDRRAFSGIPDAYRKKI

SEQ ID NO: 76450 - protein, 290 aa, Homo sapiens
  Payload ID: 15264
  Gene Symbol: SGCD
  Gene Name: sarcoglycan, delta (35kDa dystrophin-associated glycoprotein)
  Uniprot ID: Q92629
  ENSP ID: ENSP00000338343
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 76451 - protein, 289 aa, Homo sapiens
  Payload ID: 15264
  Gene Symbol: SGCD
  Gene Name: sarcoglycan, delta (35kDa dystrophin-associated glycoprotein)
  Uniprot ID: Q92629
  ENSP ID: ENSP00000403003
MPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 76452 - protein, 256 aa, Homo sapiens
  Payload ID: 15264
  Gene Symbol: SGCD
  Gene Name: sarcoglycan, delta (35kDa dystrophin-associated glycoprotein)
  Uniprot ID: Q92629
  ENSP ID: ENSP00000429378
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEVRDEKDRSSKSYSFNRPTLPITG

SEQ ID NO: 76453 - protein, 82 aa, Homo sapiens
  Payload ID: 15264
  Gene Symbol: SGCD
  Gene Name: sarcoglycan, delta (35kDa dystrophin-associated glycoprotein)
  ENSP ID: ENSP00000430794
MMPQEQYTHHRSTMPGSVGPQVYKVGIYGWRKRCLYFFVLLLMILILVNLAMTIWILKVMNFTISIHLLLRFNWLFRCCGMS

SEQ ID NO: 76454 - protein, 437 aa, Homo sapiens
  Payload ID: 15265
  Gene Symbol: SGCE
  Gene Name: sarcoglycan, epsilon
  Uniprot ID: O43556
  ENSP ID: ENSP00000265735
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 76455 - protein, 428 aa, Homo sapiens
  Payload ID: 15265
  Gene Symbol: SGCE
  Gene Name: sarcoglycan, epsilon
  ENSP ID: ENSP00000388734
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 76456 - protein, 43 aa, Homo sapiens
  Payload ID: 15265
  Gene Symbol: SGCE
  Gene Name: sarcoglycan, epsilon
  ENSP ID: ENSP00000391892
MQLPRWWELGDPCAWTGQGRGTRRMSPATTGTFLLTVEYERDK

SEQ ID NO: 76457 - protein, 396 aa, Homo sapiens
  Payload ID: 15265
  Gene Symbol: SGCE
  Gene Name: sarcoglycan, epsilon
  ENSP ID: ENSP00000394061
MQLPRWWELGDPCAWTGQGRGTRRMSPATTGTFLLTGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 76458 - protein, 451 aa, Homo sapiens
  Payload ID: 15265
  Gene Symbol: SGCE
  Gene Name: sarcoglycan, epsilon
  Uniprot ID: O43556
  ENSP ID: ENSP00000397536
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVIQLVHHSAIQKSTKELRDMSKNREIAWPLSTLPVFHPVTGEIIPPLHTDNYDSTNMPLMQTQQNLPHQTQIPQQQTTGDFRLTTFQRFEVNGIPEERKLTEAMNL

SEQ ID NO: 76459 - protein, 43 aa, Homo sapiens; identical to SEQ ID NO: 76456
  Payload ID: 15265
  Gene Symbol: SGCE
  Gene Name: sarcoglycan, epsilon
  ENSP ID: ENSP00000398344

SEQ ID NO: 76460 - protein, 462 aa, Homo sapiens
  Payload ID: 15265
  Gene Symbol: SGCE
  Gene Name: sarcoglycan, epsilon
  Uniprot ID: O43556
  ENSP ID: ENSP00000398930
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQWSFAPVAQAGVQWSDLGSLQPPPPRNLPHQTQIPQQQTTGKWYP

SEQ ID NO: 76461 - protein, 471 aa, Homo sapiens
  Payload ID: 15265
  Gene Symbol: SGCE
  Gene Name: sarcoglycan, epsilon
  ENSP ID: ENSP00000405313
MQLPRWWELGDPCAWTGQGRGTRRMSPATTGTFLLTAFLLSCADGINGTVNWKTRQANNFIISRKMAAGMKDVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGEC

SEQ ID NO: 76462 - protein, 41 aa, Homo sapiens
  Payload ID: 15265
  Gene Symbol: SGCE
  Gene Name: sarcoglycan, epsilon
  ENSP ID: ENSP00000431080
TDFLITLAVPSAVALVLFLILAYIMCCRREGVEKRNMQTPE

SEQ ID NO: 76463 - protein, 291 aa, Homo sapiens
  Payload ID: 15266
  Gene Symbol: SGCG
  Gene Name: sarcoglycan, gamma (35kDa dystrophin-associated glycoprotein)
  Uniprot ID: Q13326
  ENSP ID: ENSP00000218867
MVREQYTTATEGICIERPENQYVYKIGIYGWRKRCLYLFVLLLLIILVVNLALTIWILKVMWFSPAGMGHLCVTKDGLRLEGESEFLFPLYAKEIHSRVDSSLLLQSTQNVTVNARNSEGEVTGRLKVGPKMVEVQNQQFQINSNDGKPLFTVDEKEVVVGTDKLRVTGPEGALFEHSVETPLVRADPFQDLRLESPTRSLSMDAPRGVHIQAHAGKIEALSQMDILFHSSDGMLVLDAETVCLPKLVQGTWGPSGSSQSLYEICVCPDGKLYLSVAGVSTTCQEHNHICL

SEQ ID NO: 76464 - protein, 312 aa, Homo sapiens
  Payload ID: 15267
  Gene Symbol: SGCZ
  Gene Name: sarcoglycan, zeta
  Uniprot ID: Q96LD1
  ENSP ID: ENSP00000371512
MDRSTNLDIEELKMTREQYILATQQNNLPRTENAQLYPVGIYGWRKRCLYFFVLLLLVTMIVNLAMTIWILKVMNFTVDGMGNLRVTKKGIRLEGISEFLLPLYVKEIHSRKDSPLVLQSDRNVTVNARNHMGQLTGQLTIGADAVEAQCKRFEVRASEDGRVLFSADEDEITIGAEKLKVTGTEGAVFGHSVETPHIRAEPSQDLRLESPTRSLIMEAPRGVQVSAAAGDFKATCRKELHLQSTEGEIFLNAETIKLGNLPTGSFSSSSPSSSSSRQTVYELCVCPNGKLYLSPAGVGSTCQSSSNICLWS

SEQ ID NO: 76465 - protein, 265 aa, Homo sapiens
  Payload ID: 15267
  Gene Symbol: SGCZ
  Gene Name: sarcoglycan, zeta
  ENSP ID: ENSP00000405224
MTREQYILATQQNNLPRTENAQLYPVGIYGWRKRCLYFFVLLLLVTMIVNLAMTIWILKVMNFTVDSPLVLQSDRNVTVNARNHMGQLTGQLTIGADAVEAQCKRFEVRASEDGRVLFSADEDEITIGAEKLKVTGTEGAVFGHSVETPHIRAEPSQDLRLESPTRSLIMEAPRGVQVSAAAGDFKATCRKELHLQSTEGEIFLNAETIKLGNLPTGSFSSSSPSSSSSRQTVYELCVCPNGKLYLSPAGVGSTCQSSSNICLWS

SEQ ID NO: 76466 - protein, 181 aa, Homo sapiens
  Payload ID: 15267
  Gene Symbol: SGCZ
  Gene Name: sarcoglycan, zeta
  ENSP ID: ENSP00000481839
MGQLTGQLTIGADAVEAQCKRFEVRASEDGRVLFSADEDEITIGAEKLKVTGTEGAVFGHSVETPHIRAEPSQDLRLESPTRSLIMEAPRGVQVSAAAGDFKATCRKELHLQSTEGEIFLNAETIKLGNLPTGSFSSSSPSSSSSRQTVYELCVCPNGKLYLSPAGVGSTCQSSSNICLWS

SEQ ID NO: 76467 - protein, 811 aa, Homo sapiens
  Payload ID: 15268
  Gene Symbol: SLMAP
  Gene Name: sarcolemma associated protein
  Uniprot ID: Q14BN4
  ENSP ID: ENSP00000295951
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 76468 - protein, 811 aa, Homo sapiens; identical to SEQ ID NO: 76467
  Payload ID: 15268
  Gene Symbol: SLMAP
  Gene Name: sarcolemma associated protein
  Uniprot ID: Q14BN4
  ENSP ID: ENSP00000295952

SEQ ID NO: 76469 - protein, 506 aa, Homo sapiens
  Payload ID: 15268
  Gene Symbol: SLMAP
  Gene Name: sarcolemma associated protein
  Uniprot ID: Q14BN4
  ENSP ID: ENSP00000373224
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLGIQVDDFLPKINGSTEKEKLIVEGHLTKAVEETKLSKENQTRAKESDFSDTLSPSKEKSSDDTTDAQMDEQDLNEPLAKVSLLKGTLTCFYDIVNQGIKSPFAIKSVLDIM

SEQ ID NO: 76470 - protein, 433 aa, Homo sapiens
  Payload ID: 15268
  Gene Symbol: SLMAP
  Gene Name: sarcolemma associated protein
  ENSP ID: ENSP00000389978
  MOD_RES (1)..(1): Any amino acid
XQAEKKELQHKIDEMEEKEQELQAKIEALQADNDFTNERLTALQENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 76471 - protein, 316 aa, Homo sapiens
  Payload ID: 15268
  Gene Symbol: SLMAP
  Gene Name: sarcolemma associated protein
  ENSP ID: ENSP00000391886
  MOD_RES (1)..(1): Any amino acid
XGHLTKAVEETKLSKENQTRAKESDFSDTLSPSKEKSSDDTTDAQMDEQDLNEPLAKVSLLKALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEVKRKDIMSPIMVGLKAKSKSDIHAS

SEQ ID NO: 76472 - protein, 828 aa, Homo sapiens
  Payload ID: 15268
  Gene Symbol: SLMAP
  Gene Name: sarcolemma associated protein
  Uniprot ID: Q14BN4
  ENSP ID: ENSP00000398661
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 76473 - protein, 409 aa, Homo sapiens
  Payload ID: 15268
  Gene Symbol: SLMAP
  Gene Name: sarcolemma associated protein
  ENSP ID: ENSP00000412829
  MOD_RES (1)..(1): Any amino acid
XKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 76474 - protein, 790 aa, Homo sapiens
  Payload ID: 15268
  Gene Symbol: SLMAP
  Gene Name: sarcolemma associated protein
  Uniprot ID: Q14BN4
  ENSP ID: ENSP00000412945
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQEKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 76475 - protein, 101 aa, Homo sapiens
  Payload ID: 15268
  Gene Symbol: SLMAP
  Gene Name: sarcolemma associated protein
  ENSP ID: ENSP00000417541
MDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKD

SEQ ID NO: 76476 - protein, 318 aa, Homo sapiens
  Payload ID: 15268
  Gene Symbol: SLMAP
  Gene Name: sarcolemma associated protein
  ENSP ID: ENSP00000418218
MDEQDLNEPLAKVSLLKALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 76477 - protein, 362 aa, Homo sapiens
  Payload ID: 15268
  Gene Symbol: SLMAP
  Gene Name: sarcolemma associated protein
  ENSP ID: ENSP00000419543
MDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 76478 - protein, 170 aa, Homo sapiens
  Payload ID: 15268
  Gene Symbol: SLMAP
  Gene Name: sarcolemma associated protein
  ENSP ID: ENSP00000419849
ERTQEELRELANKYNGAVNEIKDLSDKLKVAEGKQEEIQQKGQAEKKELQHKIDEMEEKEQELQAKIEALQADNDFTNERLTALQGIQVDDFLPKINGSTEKEHLLSKSGGDCTFIHQFIECQKKLIVEGHLTKAVEETKLSKENQTRAKESDFSDTLSPSKEKSSDDTT

SEQ ID NO: 76479 - protein, 109 aa, Homo sapiens
  Payload ID: 15268
  Gene Symbol: SLMAP
  Gene Name: sarcolemma associated protein
  ENSP ID: ENSP00000420697
MDEQDLNEPLAKVSLLKALLEEERKAYRNQVEESTKQIQVLQAQLQRLHIDTENLREEKDSEITSTRDELLSARDEILLLHQAAAKVASERDTDIASLQEELKKVRAEL

SEQ ID NO: 76480 - protein, 65 aa, Homo sapiens
  Payload ID: 15268
  Gene Symbol: SLMAP
  Gene Name: sarcolemma associated protein
  ENSP ID: ENSP00000420703
  MOD_RES (1)..(1): Any amino acid
XELENQVGSLKEQHLRDSADLKTLLSKAENQAKDVQKEPSILQPVPAVFIGLFLAFLFWCFGPLW

SEQ ID NO: 76481 - protein, 31 aa, Homo sapiens
  Payload ID: 15269
  Gene Symbol: SLN
  Gene Name: sarcolipin
  Uniprot ID: O00631
  ENSP ID: ENSP00000304707
MGINTRELFLNFTIVLITVILMWLLVRSYQY

SEQ ID NO: 76482 - protein, 31 aa, Homo sapiens; identical to SEQ ID NO: 76481
  Payload ID: 15269
  Gene Symbol: SLN
  Gene Name: sarcolipin
  Uniprot ID: O00631
  ENSP ID: ENSP00000434189

SEQ ID NO: 76483 - protein, 31 aa, Homo sapiens; identical to SEQ ID NO: 76481
  Payload ID: 15269
  Gene Symbol: SLN
  Gene Name: sarcolipin
  Uniprot ID: O00631
  ENSP ID: ENSP00000435380

SEQ ID NO: 76484 - protein, 904 aa, Homo sapiens
  Payload ID: 15270
  Gene Symbol: SAGE1
  Gene Name: sarcoma antigen 1
  Uniprot ID: Q9NXZ1
  ENSP ID: ENSP00000323191
MQASPLQTSQPTPPEELHAAAYVFTNDGQQMRSDEVNLVATGHQSKKKHSRKSKRHSSSKRRKSMSSWLDKQEDAAVTHSICEERINNGQPVADNVLSTAPPWPDATIAHNIREERMENGQSRTDKVLSTAPPQLVHMAAAGIPSMSTRDLHSTVTHNIREERMENGQPQPDNVLSTGPTGLINMAATPIPAMSARDLYATVTHNVCEQKMENVQPAPDNVLLTLRPRRINMTDTGISPMSTRDPYATITYNVPEEKMEKGQPQPDNILSTASTGLINVAGAGTPAISTNGLYSTVPHNVCEEKMENDQPQPNNVLSTVQPVIIYLTATGIPGMNTRDQYATITHNVCEERVVNNQPLPSNALSTVLPGLAYLATADMPAMSTRDQHATIIHNLREEKKDNSQPTPDNVLSAVTPELINLAGAGIPPMSTRDQYATVNHHVHEARMENGQRKQDNVLSNVLSGLINMAGASIPAMSSRDLYATITHSVREEKMESGKPQTDKVISNDAPQLGHMAAGGIPSMSTKDLYATVTQNVHEERMENNQPQPSYDLSTVLPGLTYLTVAGIPAMSTRDQYATVTHNVHEEKIKNGQAASDNVFSTVPPAFINMAATGVSSMSTRDQYAAVTHNIREEKINNSQPAPGNILSTAPPWLRHMAAAGISSTITRDLYVTATHSVHEEKMTNGQQAPDNSLSTVPPGCINLSGAGISCRSTRDLYATVIHDIQEEEMENDQTPPDGFLSNSDSPELINMTGHCMPPNALDSFSHDFTSLSKDELLYKPDSNEFAVGTKNYSVSAGDPPVTVMSLVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 76485 - protein, 904 aa, Homo sapiens; identical to SEQ ID NO: 76484
  Payload ID: 15270
  Gene Symbol: SAGE1
  Gene Name: sarcoma antigen 1
  Uniprot ID: Q9NXZ1
  ENSP ID: ENSP00000359743

SEQ ID NO: 76486 - protein, 528 aa, Homo sapiens
  Payload ID: 15270
  Gene Symbol: SAGE1
  Gene Name: sarcoma antigen 1
  ENSP ID: ENSP00000438276
MQASPLQTSQPTPPEELHAAAYVFTNDGQQMRSDEVNLVATGHQSKKKHSRKSKRHSSSKRRKSMSSWLDKQEDAAVTHSICEERINNGQPVADNVLSTAPPWPDATIAHNIREERMENGQSRTDKVLSTAPPQLVHMAAAGIPSMSTRDLHATVTQNVHEERMENNQPQPSYDLSTVLPGLTYLTVAGIPAMSTRDQYATVTHNVHEEKIKNGQAASDNVFSTVPPAFINMAATGVSSMSTRDQYAAVTHNIREEKINNSQPAPGNILSTAPPWLRHMAAAGISSTITRDLYVTATHSVHEEKMTNGQQAPDNSLSTVPPGCINLSGAGISCRSTRDLYATVIHDIQEEEMENDQTPPDGFLSNSDSPELINMTGHCMPPNALDSFSHDFTSLSKDELLYKPDSNEFAVGTKNYSVSAGDPPVTVMSLVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 76487 - protein, 396 aa, Homo sapiens
  Payload ID: 15271
  Gene Symbol: SARDH
  Gene Name: sarcosine dehydrogenase
  ENSP ID: ENSP00000298628
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQSFTLLPTLEYSGTVSAHCNLRLPGSSNSRASASHVAGIKCARHHTRLIFFCILVETEFHHVAKAGLELLSSGNPPISDFQSARITGVSHHA

SEQ ID NO: 76488 - protein, 283 aa, Homo sapiens
  Payload ID: 15271
  Gene Symbol: SARDH
  Gene Name: sarcosine dehydrogenase
  ENSP ID: ENSP00000360933
MSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEAVKYRPRAAGGLCLKTSTEKVCAVWSDDLRRA

SEQ ID NO: 76489 - protein, 368 aa, Homo sapiens
  Payload ID: 15271
  Gene Symbol: SARDH
  Gene Name: sarcosine dehydrogenase
  ENSP ID: ENSP00000360934
MSYFGKFYLVGLDARKAADWLFSADVSRPPGSTVYTCMLNHRGGTESDLTVSRLAPSHQASPLAPAFEGDGYYLAMGGAVAQHNWSHITTVLQDQKSQCQLIDSSEDLGMISIQGPASRAILQEVLDADLSNEAFPFSTHKLLRAAGHLVRAMRLSFVGELGWELHIPKASCVPVYRAVMAAGAKHGLINAGYRAIDSLSIEKGYRHWHADLRPDDSPLEAGLAFTCKLKSPVPFLGREALEQQRAAGLRRRLVCFTMEEPLWTRPHPAVSGAPAFSTASSSKVPMFGLEAIWRNGQVVGHVRRADFGFAIDKTIAYGYIHDPSGGPVSLDFVKSGDYALERMGVTYGAQAHLKSPFDPNNKRVKGIY

SEQ ID NO: 76490 - protein, 918 aa, Homo sapiens
  Payload ID: 15271
  Gene Symbol: SARDH
  Gene Name: sarcosine dehydrogenase
  Uniprot ID: Q9UL12
  ENSP ID: ENSP00000360938
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGMMLGGGCGQELAHWIIHGRPEKDMHGYDIRRFHHSLTDHPRWIRERSHESYAKNYSVVFPHDEPLAGRNMRRDPLHEELLGQGCVFQERHGWERPGWFHPRGPAPVLEYDYYGAYGSRAHEDYAYRRLLADEYTFAFPPHHDTIKKECLACRGAAAVFDMSYFGKFYLVGLDARKAADWLFSADVSRPPGSTVYTCMLNHRGGTESDLTVSRLAPSHQASPLAPAFEGDGYYLAMGGAVAQHNWSHITTVLQDQKSQCQLIDSSEDLGMISIQGPASRAILQEVLDADLSNEAFPFSTHKLLRAAGHLVRAMRLSFVGELGWELHIPKASCVPVYRAVMAAGAKHGLINAGYRAIDSLSIEKGYRHWHADLRPDDSPLEAGLAFTCKLKSPVPFLGREALEQQRAAGLRRRLVCFTMEDKVPMFGLEAIWRNGQVVGHVRRADFGFAIDKTIAYGYIHDPSGGPVSLDFVKSGDYALERMGVTYGAQAHLKSPFDPNNKRVKGIY

SEQ ID NO: 76491 - protein, 608 aa, Homo sapiens
  Payload ID: 15271
  Gene Symbol: SARDH
  Gene Name: sarcosine dehydrogenase
  ENSP ID: ENSP00000394210
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGMMLGGGCGQELAHWIIHGRPEKDMHGYDIRRFHHSLTDHPRWIRERSHESYAKNYSVVFPHDEPLAGRNMRRDPLHEELLGQGCVFQERHGWERPGWFHPRGPAPVLEYDYYGAYGSRAHEDYAYRRLLADEYTFAFPPHHDTIKKECLACRGAAAVFDMSYFGKFYLVGLDARKAADWLFSADVSRPPGSTVYT

SEQ ID NO: 76492 - protein, 918 aa, Homo sapiens; identical to SEQ ID NO: 76490
  Payload ID: 15271
  Gene Symbol: SARDH
  Gene Name: sarcosine dehydrogenase
  Uniprot ID: Q9UL12
  ENSP ID: ENSP00000403084

SEQ ID NO: 76493 - protein, 602 aa, Homo sapiens
  Payload ID: 15271
  Gene Symbol: SARDH
  Gene Name: sarcosine dehydrogenase
  ENSP ID: ENSP00000415537
MAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGMMLGGGCGQELAHWIIHGRPEKDMHGYDIRRFHHSLTDHPRWIRERSHESYAKNYSVVFPHDEPLAGRNMRRDPLHEELLGQGCVFQERHGWERPGWFHPRGPAPVLEYDYYGAYGSRAHEDYAYRRLLADEYTFAFPPHHDTIKKECLACRGAAAVFDMSYFGKFYLVGLDARKAADWLFSADVSRPPGSTVYTCMLNHRGGTESDLTVSRLAPSHQASPLAPAFEGDGYYLAMGGAVAQHNWSHITTVLQDQKSQCQLIDSSEDLGMISIQGPASRAILQEVLDADLSNEAFPFSTHKLLRAAGHLVRAMRLSFVGELGWELHIPKASCVPVYRAVMAAGAKHGLINAGYRAIDSLSIEKGYRHWHADLRPDDSPLEAGLAFTCKLKSPVPFLGREALEQQRAAGLRRRLVCFTMEDKVPMFGLEAIWRNGQVVGHVRRADFGFAIDKTIATVTSMTPAVGRSRWTL

SEQ ID NO: 76494 - protein, 474 aa, Homo sapiens
  Payload ID: 15271
  Gene Symbol: SARDH
  Gene Name: sarcosine dehydrogenase
  ENSP ID: ENSP00000484683
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGMMLGGGCGQELAHWIIHGRPEKDMHGYDIRRFHHSLTDHPRWIRERSHESYAELLRRLPPR

SEQ ID NO: 76495 - protein, 243 aa, Homo sapiens
  Payload ID: 15272
  Gene Symbol: SSPN
  Gene Name: sarcospan
  Uniprot ID: Q14714
  ENSP ID: ENSP00000242729
MGKNKQPRGQQRQGGPPAADAAGPDDMEPKKGTGAPKECGEEEPRTCCGCRFPLLLALLQLALGIAVTVVGFLMASISSSLLVRDTPFWAGIIVCLVAYLGLFMLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQVFYVGVRICSLTASEGPQQKI

SEQ ID NO: 76496 - protein, 140 aa, Homo sapiens
  Payload ID: 15272
  Gene Symbol: SSPN
  Gene Name: sarcospan
  Uniprot ID: Q14714
  ENSP ID: ENSP00000396087
MLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQVFYVGVRICSLTASEGPQQKI

SEQ ID NO: 76497 - protein, 128 aa, Homo sapiens
  Payload ID: 15272
  Gene Symbol: SSPN
  Gene Name: sarcospan
  ENSP ID: ENSP00000438801
MGKNKQPRGQQRQGGPPAADAAGPDDMEPKKGTGAPKECGEEEPRTCCGCRFPLLLALLQLALGIAVTVVGFLMASISSSLLVRDTPFWAGIIVCLVAYLGLFMLCVSYQVDERTCIQFSMKIHCHDF

SEQ ID NO: 76498 - protein, 140 aa, Homo sapiens; identical to SEQ ID NO: 76496
  Payload ID: 15272
  Gene Symbol: SSPN
  Gene Name: sarcospan
  Uniprot ID: Q14714
  ENSP ID: ENSP00000442893

SEQ ID NO: 76499 - protein, 120 aa, Homo sapiens
  Payload ID: 15272
  Gene Symbol: SSPN
  Gene Name: sarcospan
  ENSP ID: ENSP00000445360
MLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQV

SEQ ID NO: 76500 - protein, 657 aa, Homo sapiens
  Payload ID: 15273
  Gene Symbol: SASS6
  Gene Name: SAS-6 centriolar assembly protein
  Uniprot ID: Q6UVJ0
  ENSP ID: ENSP00000287482
MSQVLFHQLVPLQVKCKDCEERRVSIRMSIELQSVSNPVHRKDLVIRLTDDTDPFFLYNLVISEEDFQSLKFQQGLLVDFLAFPQKFIDLLQQCTQEHAKEIPRFLLQLVSPAAILDNSPAFLNVVETNPFKHLTHLSLKLLPGNDVEIKKFLAGCLKCSKEEKLSLMQSLDDATKQLDFTRKTLAEKKQELDKLRNEWASHTAALTNKHSQELTNEKEKALQAQVQYQQQHEQQKKDLEILHQQNIHQLQNRLSELEAANKDLTERKYKGDSTIRELKAKLSGVEEELQRTKQEVLSLRRENSTLDVECHEKEKHVNQLQTKVAVLEQEIKDKDQLVLRTKEAFDTIQEQKVVLEENGEKNQVQLGKLEATIKSLSAELLKANEIIKKLQGDLKTLMGKLKLKNTVTIQQEKLLAEKEEKLQKEQKELQDVGQSLRIKEQEVCKLQEQLEATVKKLEESKQLLKNNEKLITWLNKELNENQLVRKQDVLGPSTTPPAHSSSNTIRSGISPNLNVVDGRLTYPTCGIGYPVSSAFAFQNTFPHSISAKNTSHPGSGTKVQFNLQFTKPNASLGDVQSGATISMPCSTDKENGENVGLESKYLKKREDSIPLRGLSQNLFSNSDHQRDGTLGALHTSSKPTALPSASSAYFPGQLPNS

SEQ ID NO: 76501 - protein, 763 aa, Homo sapiens
  Payload ID: 15274
  Gene Symbol: SATB1
  Gene Name: SATB homeobox 1
  Uniprot ID: Q01826
  ENSP ID: ENSP00000341024
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 76502 - protein, 166 aa, Homo sapiens
  Payload ID: 15274
  Gene Symbol: SATB1
  Gene Name: SATB homeobox 1
  ENSP ID: ENSP00000390529
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTL

SEQ ID NO: 76503 - protein, 70 aa, Homo sapiens
  Payload ID: 15274
  Gene Symbol: SATB1
  Gene Name: SATB homeobox 1
  ENSP ID: ENSP00000391344
MDHLNEATQGKEHSEMSNNVSDPKGPPAKIARLEQNGSPLGRGRLGSTGAKMQGVPLKHSGHLMKTNLRK

SEQ ID NO: 76504 - protein, 8 aa, Homo sapiens
  Payload ID: 15274
  Gene Symbol: SATB1
  Gene Name: SATB homeobox 1
  ENSP ID: ENSP00000394520
MDHLNEAT

SEQ ID NO: 76505 - protein, 129 aa, Homo sapiens
  Payload ID: 15274
  Gene Symbol: SATB1
  Gene Name: SATB homeobox 1
  ENSP ID: ENSP00000398072
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAK

SEQ ID NO: 76506 - protein, 795 aa, Homo sapiens
  Payload ID: 15274
  Gene Symbol: SATB1
  Gene Name: SATB homeobox 1
  Uniprot ID: Q01826
  ENSP ID: ENSP00000399518
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQSPSPTTLGKGESRGVFLPGLPTPAPWLGAAPQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 76507 - protein, 763 aa, Homo sapiens; identical to SEQ ID NO: 76501
  Payload ID: 15274
  Gene Symbol: SATB1
  Gene Name: SATB homeobox 1
  Uniprot ID: Q01826
  ENSP ID: ENSP00000399708

SEQ ID NO: 76508 - protein, 224 aa, Homo sapiens
  Payload ID: 15274
  Gene Symbol: SATB1
  Gene Name: SATB homeobox 1
  ENSP ID: ENSP00000402982
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTY

SEQ ID NO: 76509 - protein, 172 aa, Homo sapiens
  Payload ID: 15274
  Gene Symbol: SATB1
  Gene Name: SATB homeobox 1
  ENSP ID: ENSP00000406727
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHR

SEQ ID NO: 76510 - protein, 116 aa, Homo sapiens
  Payload ID: 15274
  Gene Symbol: SATB1
  Gene Name: SATB homeobox 1
  ENSP ID: ENSP00000408871
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALL

SEQ ID NO: 76511 - protein, 82 aa, Homo sapiens
  Payload ID: 15274
  Gene Symbol: SATB1
  Gene Name: SATB homeobox 1
  ENSP ID: ENSP00000453908
MDHLNEATQGKEHSEMSNNVSDPKGPPAKIARLEQNGSPLGRGRLGSTGAKMQGVPLKHSGHLMKTNLRKDIEIVYYEHQFG

SEQ ID NO: 76512 - protein, 138 aa, Homo sapiens
  Payload ID: 15274
  Gene Symbol: SATB1
  Gene Name: SATB homeobox 1
  ENSP ID: ENSP00000479866
MLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQHPEISNMLDNLFINGKINFKKKLPRAPEA

SEQ ID NO: 76513 - protein, 166 aa, Homo sapiens
  Payload ID: 15274
  Gene Symbol: SATB1
  Gene Name: SATB homeobox 1
  ENSP ID: ENSP00000480000
MLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGR

SEQ ID NO: 76514 - protein, 733 aa, Homo sapiens
  Payload ID: 15275
  Gene Symbol: SATB2
  Gene Name: SATB homeobox 2
  Uniprot ID: Q9UPW6
  ENSP ID: ENSP00000260926
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 76515 - protein, 615 aa, Homo sapiens
  Payload ID: 15275
  Gene Symbol: SATB2
  Gene Name: SATB homeobox 2
  Uniprot ID: Q9UPW6
  ENSP ID: ENSP00000388581
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 76516 - protein, 674 aa, Homo sapiens
  Payload ID: 15275
  Gene Symbol: SATB2
  Gene Name: SATB homeobox 2
  ENSP ID: ENSP00000388764
MERRSESPCLRDSPDRRSGSPDVKGPPPVKVARLEQNGSPMGARGRPNGAVAKAVGGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 76517 - protein, 733 aa, Homo sapiens; identical to SEQ ID NO: 76514
  Payload ID: 15275
  Gene Symbol: SATB2
  Gene Name: SATB homeobox 2
  Uniprot ID: Q9UPW6
  ENSP ID: ENSP00000401112

SEQ ID NO: 76518 - protein, 733 aa, Homo sapiens; identical to SEQ ID NO: 76514
  Payload ID: 15275
  Gene Symbol: SATB2
  Gene Name: SATB homeobox 2
  Uniprot ID: Q9UPW6
  ENSP ID: ENSP00000405420

SEQ ID NO: 76519 - protein, 126 aa, Homo sapiens
  Payload ID: 15275
  Gene Symbol: SATB2
  Gene Name: SATB homeobox 2
  ENSP ID: ENSP00000415610
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGWRAANPASWI

SEQ ID NO: 76520 - protein, 615 aa, Homo sapiens; identical to SEQ ID NO: 76515
  Payload ID: 15275
  Gene Symbol: SATB2
  Gene Name: SATB homeobox 2
  Uniprot ID: Q9UPW6
  ENSP ID: ENSP00000483287

SEQ ID NO: 76521 - protein, 183 aa, Homo sapiens
  Payload ID: 15276
  Gene Symbol: SAYSD1
  Gene Name: SAYSVFN motif domain containing 1
  Uniprot ID: Q9NPB0
  ENSP ID: ENSP00000229903
MEQRLAEFRAARKRAGLAAQPPAASQGAQTPGEKAEAAATLKAAPGWLKRFLVWKPRPASARAQPGLVQEAAQPQGSTSETPWNTAIPLPSCWDQSFLTNITFLKVLLWLVLLGLFVELEFGLAYFVLSLFYWMYVGTRGPEEKKEGEKSAYSVFNPGCEAIQGTLTAEQLERELQLRPLAGR

SEQ ID NO: 76522 - protein, 116 aa, Homo sapiens
  Payload ID: 15276
  Gene Symbol: SAYSD1
  Gene Name: SAYSVFN motif domain containing 1
  Uniprot ID: Q9NPB0
  ENSP ID: ENSP00000362346
MLEAAQPQGSTSETPWNTAIPLPSCWDQSFLTNITFLKVLLWLVLLGLFVELEFGLAYFVLSLFYWMYVGTRGPEEKKEGEKSAYSVFNPGCEAIQGTLTAEQLERELQLRPLAGR

SEQ ID NO: 76523 - protein, 915 aa, Homo sapiens
  Payload ID: 15277
  Gene Symbol: SAFB
  Gene Name: scaffold attachment factor B
  Uniprot ID: Q15424
  ENSP ID: ENSP00000292123
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 76524 - protein, 848 aa, Homo sapiens
  Payload ID: 15277
  Gene Symbol: SAFB
  Gene Name: scaffold attachment factor B
  Uniprot ID: Q15424
  ENSP ID: ENSP00000415895
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 76525 - protein, 153 aa, Homo sapiens
  Payload ID: 15277
  Gene Symbol: SAFB
  Gene Name: scaffold attachment factor B
  ENSP ID: ENSP00000464758
SRDSESHRSPSAALLLCSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGR

SEQ ID NO: 76526 - protein, 916 aa, Homo sapiens
  Payload ID: 15277
  Gene Symbol: SAFB
  Gene Name: scaffold attachment factor B
  Uniprot ID: Q15424
  ENSP ID: ENSP00000464840
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 76527 - protein, 917 aa, Homo sapiens
  Payload ID: 15277
  Gene Symbol: SAFB
  Gene Name: scaffold attachment factor B
  Uniprot ID: Q15424
  ENSP ID: ENSP00000467423
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 76528 - protein, 106 aa, Homo sapiens
  Payload ID: 15277
  Gene Symbol: SAFB
  Gene Name: scaffold attachment factor B
  ENSP ID: ENSP00000468543
MAETLSGLGDSGAAGAAALSSASSETGTRRLSDLRVIDLRAELRKRNVDSSGNKSVLMERLKKAIEDEGGNPDEIEITSEGNKKTSKRSSKDRGQRNYKQFRYFII

SEQ ID NO: 76529 - protein, 953 aa, Homo sapiens
  Payload ID: 15278
  Gene Symbol: SAFB2
  Gene Name: scaffold attachment factor B2
  Uniprot ID: Q14151
  ENSP ID: ENSP00000252542
MAETLPGSGDSGPGTASLGPGVAETGTRRLSELRVIDLRAELKKRNLDTGGNKSVLMERLKKAVKEEGQDPDEIGIELEATSKKSAKRCVKGLKMEEEGTEDNGLEDDSRDGQEDMEASLENLQNMGMMDMSVLDETEVANSSAPDFGEDGTDGLLDSFCDSKEYVAAQLRQLPAQPPEHAVDGEGFKNTLETSSLNFKVTPDIEESLLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSFKEEKDIKPIIKDEKGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDRHHSVEIKIEKTVIKKEEKIEKKEEKKPEDIKKEEKDQDELKPGPTNRSRVTKSGSRGMERTVVMDKSKGEPVISVKTTSRSKERSSKSQDRKSESKEKRDILSFDKIKEQRERERQRQREREIRETERRREREQREREQRLEAFHERKEKARLQRERLQLECQRQRLERERMERERLERERMRVERERRKEQERIHREREELRRQQEQLRYEQERRPGRRPYDLDRRDDAYWPEGKRVAMEDRYRADFPRPDHRFHDFDHRDRGQYQDHAIDRREGSRPMMGDHRDGQHYGDDRHGHGGPPERHGRDSRDGWGGYGSDKRLSEGRGLPPPPRGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 76530 - protein, 87 aa, Homo sapiens
  Payload ID: 15278
  Gene Symbol: SAFB2
  Gene Name: scaffold attachment factor B2
  ENSP ID: ENSP00000467981
VLDETEVANSSAPDFGEDGTDGLLDSFCDSKEYVAAQLRQLPAQPPEHAVDGEGFKNTLETSSLNFKVTPDIEESLLEPALLRKKKI

SEQ ID NO: 76531 - protein, 124 aa, Homo sapiens
  Payload ID: 15278
  Gene Symbol: SAFB2
  Gene Name: scaffold attachment factor B2
  ENSP ID: ENSP00000468454
MEEEGTEDNGLEDDSRDGQEDMEASLENLQNMGMMDMSVLDETEVANSSAPDFGEDGTDGLLDSFCDSKEYVAAQLRQLPAQPPEHAVDGEGFKNTLETSSLNFKVTPDIEESLLEPGTDKRNT

SEQ ID NO: 76532 - protein, 115 aa, Homo sapiens
  Payload ID: 15278
  Gene Symbol: SAFB2
  Gene Name: scaffold attachment factor B2
  Uniprot ID: Q14151
  ENSP ID: ENSP00000468505
MAETLPGSGDSGPGTASLGPGVAETGTRRLSELRVIDLRAELKKRNLDTGGNKSVLMERLKKAVKEEGQDPDEIGIELEATSKKSAKRCVKGGHGSKSGEPAEYGHDGHECARRN

SEQ ID NO: 76533 - protein, 915 aa, Homo sapiens
  Payload ID: 15279
  Gene Symbol: SPIDR
  Gene Name: scaffolding protein involved in DNA repair
  Uniprot ID: Q14159
  ENSP ID: ENSP00000297423
MPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 76534 - protein, 92 aa, Homo sapiens
  Payload ID: 15279
  Gene Symbol: SPIDR
  Gene Name: scaffolding protein involved in DNA repair
  ENSP ID: ENSP00000427878
MCGNGRLEQRPEDRGAFSCGDCSRVVTSPVLKRHLQVFLDCRSRPQCRVKVKLLQRSISSLLRFAAGEDGSYEVKSVLGKEVGLLNCFVQSV

SEQ ID NO: 76535 - protein, 390 aa, Homo sapiens
  Payload ID: 15279
  Gene Symbol: SPIDR
  Gene Name: scaffolding protein involved in DNA repair
  ENSP ID: ENSP00000427889
MFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 76536 - protein, 45 aa, Homo sapiens
  Payload ID: 15279
  Gene Symbol: SPIDR
  Gene Name: scaffolding protein involved in DNA repair
  ENSP ID: ENSP00000428222
MPRGSRARGSKKKELEYRMPILSRRKTTAGQKSRSQDSRGSCLSL

SEQ ID NO: 76537 - protein, 181 aa, Homo sapiens
  Payload ID: 15279
  Gene Symbol: SPIDR
  Gene Name: scaffolding protein involved in DNA repair
  ENSP ID: ENSP00000428287
MPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKVENLVY

SEQ ID NO: 76538 - protein, 497 aa, Homo sapiens
  Payload ID: 15279
  Gene Symbol: SPIDR
  Gene Name: scaffolding protein involved in DNA repair
  ENSP ID: ENSP00000429193
  MOD_RES (1)..(1): Any amino acid
XLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRATK

SEQ ID NO: 76539 - protein, 95 aa, Homo sapiens
  Payload ID: 15279
  Gene Symbol: SPIDR
  Gene Name: scaffolding protein involved in DNA repair
  ENSP ID: ENSP00000429448
MCGNGRLEQRPEDRGAFSCGDCSRVVTSPVLKRHLQVFLDCRSRPQCRVKVKLLQRSISSLLRFAAGEDGRSRDQEPWQKSSFLHLVSFWLRATK

SEQ ID NO: 76540 - protein, 876 aa, Homo sapiens
  Payload ID: 15279
  Gene Symbol: SPIDR
  Gene Name: scaffolding protein involved in DNA repair
  Uniprot ID: Q14159
  ENSP ID: ENSP00000429487
MAQSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKVGARPEHARTPSSLQHSEELRSEECPRKGSGVVKLFCPVRNRPPDQLHWIGGNRASECRRGLCRTLAVAAGSVNFAMWLQGWWWWW

SEQ ID NO: 76541 - protein, 76 aa, Homo sapiens
  Payload ID: 15279
  Gene Symbol: SPIDR
  Gene Name: scaffolding protein involved in DNA repair
  ENSP ID: ENSP00000429805
MPRGSRARGSKRKRSWNTECPSFPGERPLQVRRAGLRTAGAAASLSEAWLRCGEGFQNTSGNPKPPHLKAPVGLQT

SEQ ID NO: 76542 - protein, 209 aa, Homo sapiens
  Payload ID: 15279
  Gene Symbol: SPIDR
  Gene Name: scaffolding protein involved in DNA repair
  ENSP ID: ENSP00000429997
MPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRDELQFIDWEIDSDRAEASDCDEFEDDEGAVEISDCASCASNQSLTSDEKLSELPKRWTSRKTKWTAESREICYFFVETSMYFLPKDTFR

SEQ ID NO: 76543 - protein, 152 aa, Homo sapiens
  Payload ID: 15279
  Gene Symbol: SPIDR
  Gene Name: scaffolding protein involved in DNA repair
  ENSP ID: ENSP00000430091
MQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRD

SEQ ID NO: 76544 - protein, 126 aa, Homo sapiens
  Payload ID: 15279
  Gene Symbol: SPIDR
  Gene Name: scaffolding protein involved in DNA repair
  ENSP ID: ENSP00000430664
MPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRGFGNYD

SEQ ID NO: 76545 - protein, 181 aa, Homo sapiens; identical to SEQ ID NO: 76537
  Payload ID: 15279
  Gene Symbol: SPIDR
  Gene Name: scaffolding protein involved in DNA repair
  ENSP ID: ENSP00000430941

SEQ ID NO: 76546 - protein, 132 aa, Homo sapiens
  Payload ID: 15279
  Gene Symbol: SPIDR
  Gene Name: scaffolding protein involved in DNA repair
  ENSP ID: ENSP00000430965
MPRGSRARGSKRKRSWNTECPSFPGERPLQVRRAGLRTAGAAASLSEAWLRCGEGFQNTSGNPSLTAEEKTITEKHLELCPRPKQETTTSKSTSGLTDITWSSSGSDLSDEDKTLSQLQRAKFYRNFRVFIR

SEQ ID NO: 76547 - protein, 845 aa, Homo sapiens
  Payload ID: 15279
  Gene Symbol: SPIDR
  Gene Name: scaffolding protein involved in DNA repair
  Uniprot ID: Q14159
  ENSP ID: ENSP00000444061
MAQVWRRVSEHFWESETTTSKSTSGLTDITWSSSGSDLSDEDKTLSQLQRDELQFIDWEIDSDRAEASDCDEFEDDEGAVEISDCASCASNQSLTSDEKLSELPKPSSIEILEYSSDSEKEDDLENVLLIDSESPHKYHVQFASDARQIMERLIDPRTKSTETILHTPQKPTAKFPRTPENSAKKKLLRGGLAERLNGLQNRERSAISLWRHQCISYQKTLSGRKSGVLTVKILELHEECAMQVAMCEQLLGSPATSSSQSVAPRPGAGLKVLFTKETAGYLRGRPQDTVRIFPPWQKLIIPSGSCPVILNTYFCEKVVAKEDSEKTCEVYCPDIPLPRRSISLAQMFVIKGLTNNSPEIQVVCSGVATTGTAWTHGHKEAKQRIPTSTPLRDSLLDVVESQGAASWPGAGVRVVVQRVYSLPSRDSTRGQQGASSGHTDPAGTRACLLVQDACGMFGEVHLEFTMSKARQLEGKSCSLVGMKVLQKVTRGRTAGIFSLIDTLWPPAIPLKTPGRDQPCEEIKTHLPPPALCYILTAHPNLGQIDIIDEDPIYKLYQPPVTRCLRDILQMNDLGTRCSFYATVIYQKPQLKSLLLLEQREIWLLVTDVTLQTKEERDPRLPKTLLVYVAPLCVLGSEVLEALAGAAPHSLFFKDALRDQGRIVCAERTVLLLQKPLLSVVSGASSCELPGPVMLDSLDSATPVNSICSVQGTVVGVDESTAFSWPVCDMCGNGRLEQRPEDRGAFSCGDCSRVVTSPVLKRHLQVFLDCRSRPQCRVKVKLLQRSISSLLRFAAGEDGSYEVKSVLGKEVGLLNCFVQSVTAHPTSCIGLEEIELLSAGGASAEH

SEQ ID NO: 76548 - protein, 179 aa, Homo sapiens
  Payload ID: 15280
  Gene Symbol: SCAND1
  Gene Name: SCAN domain containing 1
  Uniprot ID: P57086
  ENSP ID: ENSP00000301995
MAATEPILAATGSPAAVPPEKLEGAGSSSAPERNCVGSSLPEASPPAPEPSSPNAAVPEAIPTPRAAASAALELPLGPAPVSVAPQAEAEARSTPGPAGSRLGPETFRQRFRQFRYQDAAGPREAFRQLRELSRQWLRPDIRTKEQIVEMLVQEQLLAILPEAARARRIRRRTDVRITG

SEQ ID NO: 76549 - protein, 179 aa, Homo sapiens; identical to SEQ ID NO: 76548
  Payload ID: 15280
  Gene Symbol: SCAND1
  Gene Name: SCAN domain containing 1
  Uniprot ID: P57086
  ENSP ID: ENSP00000363103

SEQ ID NO: 76550 - protein, 179 aa, Homo sapiens; identical to SEQ ID NO: 76548
  Payload ID: 15280
  Gene Symbol: SCAND1
  Gene Name: SCAN domain containing 1
  Uniprot ID: P57086
  ENSP ID: ENSP00000481289

SEQ ID NO: 76551 - protein, 606 aa, Homo sapiens
  Payload ID: 15281
  Gene Symbol: SCARA3
  Gene Name: scavenger receptor class A, member 3
  Uniprot ID: Q6AZY7
  ENSP ID: ENSP00000301904
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGAPGPPGPRGFKGDMGVKGPVGGRGPKGDPGSLGPLGPQGPQGQPGEAGPVGERGPVGPRGFPGLKGSKGSFGTGGPRGQPGPKGDIGPPGPEGPPGSPGPSGPQGKPGIAGKTGSPGQRGAMGPKGEPGIQGPPGLPGPPGPPGSQSFY

SEQ ID NO: 76552 - protein, 466 aa, Homo sapiens
  Payload ID: 15281
  Gene Symbol: SCARA3
  Gene Name: scavenger receptor class A, member 3
  Uniprot ID: Q6AZY7
  ENSP ID: ENSP00000337985
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGHTLFSHNRI

SEQ ID NO: 76553 - protein, 495 aa, Homo sapiens
  Payload ID: 15282
  Gene Symbol: SCARA5
  Gene Name: scavenger receptor class A, member 5
  Uniprot ID: Q6ZMJ2
  ENSP ID: ENSP00000346990
MENKAMYLHTVSDCDTSSICEDSFDGRSLSKLNLCEDGPCHKRRASICCTQLGSLSALKHAVLGLYLLVFLILVGIFILAVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGLNHSLSYDVALHRTRLQDLRVLVSNASEDTRRLRLAHVGMELQLKQELAMLNAVTEDLRLKDWEHSIALRNISLAKGPPGPKGDQGDEGKEGRPGIPGLPGLRGLPGERGTPGLPGPKGDDGKLGATGPMGMRGFKGDRGPKGEKGEKGDRAGDASGVEAPMMIRLVNGSGPHEGRVEVYHDRRWGTVCDDGWDKKDGDVVCRMLGFRGVEEVYRTARFGQGTGRIWMDDVACKGTEETIFRCSFSKWGVTNCGHAEDASVTCNRH

SEQ ID NO: 76554 - protein, 270 aa, Homo sapiens
  Payload ID: 15282
  Gene Symbol: SCARA5
  Gene Name: scavenger receptor class A, member 5
  Uniprot ID: Q6ZMJ2
  ENSP ID: ENSP00000369746
MENKAMYLHTVSDCDTSSICEDSFDGRSLSKLNLCEDGPCHKRRASICCTQLGSLSALKHAVLGLYLLVFLILVGIFILAGPPGPKGDQGDEGKEGRPGIPGLPGLRGLPGERGTPGLPGPKGDDGKLGATGPMGMRGFKGDRGPKGEKGEKGDRAGDASGVEAPMMIRLVNGSGPHEGRVEVYHDRRWGTVCDDGWDKKDGDVVCRMLGFRGVEEVYRTARFGQGTGRIWMDDVACKGTEETIFRCSFSKWGVTNCGHAEDASVTCNRH

SEQ ID NO: 76555 - protein, 400 aa, Homo sapiens
  Payload ID: 15282
  Gene Symbol: SCARA5
  Gene Name: scavenger receptor class A, member 5
  Uniprot ID: Q6ZMJ2
  ENSP ID: ENSP00000428663
MENKAMYLHTVSDCDTSSICEDSFDGRSLSKLNLCEDGPCHKRRASICCTQLGSLSALKHAVLGLYLLVFLILVGIFILAVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGLNHSLSYDVALHRTRLQDLRVLVSNASEDTRRLRLAHVGMELQLKQELAMLNAVTEDLRLKDWEHSIALRNISLAKGPPGPKGDQGDEGKEGRPGIPGLPGLRGLPGERGTPGLPGPKGDDGKLGATGPMGMRGFKGDRGPKGEKGEKGDRAGDASKDILLGPWDMVLAQG

SEQ ID NO: 76556 - protein, 357 aa, Homo sapiens
  Payload ID: 15282
  Gene Symbol: SCARA5
  Gene Name: scavenger receptor class A, member 5
  Uniprot ID: Q6ZMJ2
  ENSP ID: ENSP00000430713
MENKAMYLHTVSDCDTSSICEDSFDGRSLSKLNLCEDVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGLNHSLSYDVALHRTRLQDLRVLVSNASEDTRRLRLAHVGMELQLKQELAMLNAVTEDLRLKDWEHSIALRNISLAKGPPGPKGDQGDEGKEGRPGIPGLPGLRGLPGERGTPGLPGPKGDDGKLGATGPMGMRGFKGDRGPKGEKGEKGDRAGDASKDILLGPWDMVLAQG

SEQ ID NO: 76557 - protein, 509 aa, Homo sapiens
  Payload ID: 15283
  Gene Symbol: SCARB1
  Gene Name: scavenger receptor class B, member 1
  Uniprot ID: Q8WTV0
  ENSP ID: ENSP00000261693
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQEKCYLFWSSSKKGSKDKEAIQAYSESLMTSAPKGSVLQEAKL

SEQ ID NO: 76558 - protein, 506 aa, Homo sapiens
  Payload ID: 15283
  Gene Symbol: SCARB1
  Gene Name: scavenger receptor class B, member 1
  Uniprot ID: Q8WTV0
  ENSP ID: ENSP00000343795
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQGPEDTVSQPGLAAGPDRPPSPYTPLLPDSPSGQPPSPTA

SEQ ID NO: 76559 - protein, 552 aa, Homo sapiens
  Payload ID: 15283
  Gene Symbol: SCARB1
  Gene Name: scavenger receptor class B, member 1
  Uniprot ID: Q8WTV0
  ENSP ID: ENSP00000414979
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQVGAGQRAARADSHSLACWGKGASDRTLWPTAAWSPPPAAVLRLCRSGSGHCWGLRSTLASFACRVATTLPVLEGLGPSLGGGTGS

SEQ ID NO: 76560 - protein, 481 aa, Homo sapiens
  Payload ID: 15283
  Gene Symbol: SCARB1
  Gene Name: scavenger receptor class B, member 1
  ENSP ID: ENSP00000442862
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKEKCYLFWSSSKKGSKDKEAIQAYSESLMTSAPKGSVLQEAKL

SEQ ID NO: 76561 - protein, 146 aa, Homo sapiens
  Payload ID: 15283
  Gene Symbol: SCARB1
  Gene Name: scavenger receptor class B, member 1
  ENSP ID: ENSP00000443454
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLVRLP

SEQ ID NO: 76562 - protein, 499 aa, Homo sapiens
  Payload ID: 15283
  Gene Symbol: SCARB1
  Gene Name: scavenger receptor class B, member 1
  ENSP ID: ENSP00000444851
MWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQVGAGQRAARADSHSLACWGKGASDRTLWPTAAWSPPPAAVLRLCRSGSGHCWGLRSTLASFACRVATTLPVLEGLGPSLGGGTGGL

SEQ ID NO: 76563 - protein, 478 aa, Homo sapiens
  Payload ID: 15284
  Gene Symbol: SCARB2
  Gene Name: scavenger receptor class B, member 2
  Uniprot ID: Q14108
  ENSP ID: ENSP00000264896
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 76564 - protein, 335 aa, Homo sapiens
  Payload ID: 15284
  Gene Symbol: SCARB2
  Gene Name: scavenger receptor class B, member 2
  Uniprot ID: Q14108
  ENSP ID: ENSP00000399154
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 76565 - protein, 106 aa, Homo sapiens
  Payload ID: 15284
  Gene Symbol: SCARB2
  Gene Name: scavenger receptor class B, member 2
  ENSP ID: ENSP00000420988
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRDKVLLCCSCWNAVA

SEQ ID NO: 76566 - protein, 830 aa, Homo sapiens
  Payload ID: 15285
  Gene Symbol: SCARF1
  Gene Name: scavenger receptor class F, member 1
  Uniprot ID: Q14162
  ENSP ID: ENSP00000263071
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 76567 - protein, 744 aa, Homo sapiens
  Payload ID: 15285
  Gene Symbol: SCARF1
  Gene Name: scavenger receptor class F, member 1
  ENSP ID: ENSP00000323964
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 76568 - protein, 342 aa, Homo sapiens
  Payload ID: 15285
  Gene Symbol: SCARF1
  Gene Name: scavenger receptor class F, member 1
  Uniprot ID: Q14162
  ENSP ID: ENSP00000411167
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRGPVIL

SEQ ID NO: 76569 - protein, 569 aa, Homo sapiens
  Payload ID: 15285
  Gene Symbol: SCARF1
  Gene Name: scavenger receptor class F, member 1
  Uniprot ID: Q14162
  ENSP ID: ENSP00000458174
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTASSSRPLPAGPLMTPSHPILSLERQMRFLPTVCHPKKGWSLWPRQGRQRPAWLQVLSRPLRTPPRHSPSRAPPA

SEQ ID NO: 76570 - protein, 49 aa, Homo sapiens
  Payload ID: 15285
  Gene Symbol: SCARF1
  Gene Name: scavenger receptor class F, member 1
  ENSP ID: ENSP00000461468
MGLGLLLPLLLLWTRGTQGSELDPKGQHVCVASRWVSWESDACGQQPLC

SEQ ID NO: 76571 - protein, 744 aa, Homo sapiens; identical to SEQ ID NO: 76567
  Payload ID: 15285
  Gene Symbol: SCARF1
  Gene Name: scavenger receptor class F, member 1
  ENSP ID: ENSP00000478675

SEQ ID NO: 76572 - protein, 830 aa, Homo sapiens; identical to SEQ ID NO: 76566
  Payload ID: 15285
  Gene Symbol: SCARF1
  Gene Name: scavenger receptor class F, member 1
  Uniprot ID: Q14162
  ENSP ID: ENSP00000481595

SEQ ID NO: 76573 - protein, 342 aa, Homo sapiens; identical to SEQ ID NO: 76568
  Payload ID: 15285
  Gene Symbol: SCARF1
  Gene Name: scavenger receptor class F, member 1
  Uniprot ID: Q14162
  ENSP ID: ENSP00000487665

SEQ ID NO: 76574 - protein, 49 aa, Homo sapiens; identical to SEQ ID NO: 76570
  Payload ID: 15285
  Gene Symbol: SCARF1
  Gene Name: scavenger receptor class F, member 1
  ENSP ID: ENSP00000488319

SEQ ID NO: 76575 - protein, 569 aa, Homo sapiens; identical to SEQ ID NO: 76569
  Payload ID: 15285
  Gene Symbol: SCARF1
  Gene Name: scavenger receptor class F, member 1
  Uniprot ID: Q14162
  ENSP ID: ENSP00000488776

SEQ ID NO: 76576 - protein, 866 aa, Homo sapiens
  Payload ID: 15286
  Gene Symbol: SCARF2
  Gene Name: scavenger receptor class F, member 2
  Uniprot ID: Q96GP6
  ENSP ID: ENSP00000477564
MEGAGPRGAGPARRRGAGGPPSPLLPSLLLLLLLWMLPDTVAPQELNPRGRNVCRAPGSQVPTCCAGWRQQGDECGIAVCEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARGRGPGLLEPTDAGGPPRSAPEAASMLAAELRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 76577 - protein, 870 aa, Homo sapiens
  Payload ID: 15286
  Gene Symbol: SCARF2
  Gene Name: scavenger receptor class F, member 2
  ENSP ID: ENSP00000479389
MEGAGPRGAGPARRRGAGGPPSPLLPSLLLLLLLWMLPDTVAPQELNPRGRNVCRAPGSQVPTCCAGWRQQGDECGIAVCEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRPRPRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARAAPRPLGAHGRRRSPAKRAEAASMLAAELRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 76578 - protein, 871 aa, Homo sapiens
  Payload ID: 15286
  Gene Symbol: SCARF2
  Gene Name: scavenger receptor class F, member 2
  ENSP ID: ENSP00000485276
MEGAGPRGAGPARRRGAGGPPSPLLPSLLLLLLLWMLPDTVAPQELNPRGRNVCRAPGSQVPTCCAGWRQQGDECGIAVCEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRPRPRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARGRGPGLLEPTDAGGPPRSAPEAASMLAAELRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 76579 - protein, 575 aa, Homo sapiens
  Payload ID: 15287
  Gene Symbol: SSC4D
  Gene Name: scavenger receptor cysteine rich family, 4 domains
  Uniprot ID: Q8WTU2
  ENSP ID: ENSP00000275560
MHKEAEMLIGPQLDEKRWGWRLGDGSAAPPFLPQALSFLLLLPLASALQPTPLPFQELRLVGGPSRCRGRLEVMHGGSWGSVCDDDWDVVDANVVCRQLGCGLALPVPRPLAFGQGRGPILLDNVECRGQEAALSECGSRGWGVHNCFHYEDVAVLCDEFLPTQPPTRKMLTSRAPPTTLPNGKSEGSVRLVGGANLCQGRVEILHSGLWGTVCDDDWGLPDAAVVCRQLGCGAAMAATTNAFFGYGTGHILLDNVHCEGGEPRLAACQSLGWGVHNCGHHEDAGALCAGLGPPTLTALPSSATREDWAWQTDPSATGVGPQPSRETALLTTAAWAAGKKSGRLRLVGGPGPCRGRVEVLHAGGWGTVCDDDWDFADARVACREAGCGPALGATGLGHFGYGRGPVLLDNVGCAGTEARLSDCFHLGWGQHNCGHHEDAGALCAGPEELGLQVQQDGSETTRVPTPRPRDGHLRLVNGAHRCEGRVELYLGQRWGTVCDDAWDLRAAGVLCRQLGCGQALAAPGEAHFGPGRGPILLDNVKCRGEESALLLCSHIRWDAHNCDHSEDASVLCQPS

SEQ ID NO: 76580 - protein, 1573 aa, Homo sapiens
  Payload ID: 15288
  Gene Symbol: SSC5D
  Gene Name: scavenger receptor cysteine rich family, 5 domains
  Uniprot ID: A1L4H1
  ENSP ID: ENSP00000374274
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTGSKDGYKLPWTWDTPSGRGLAEGTPTAGKLGPTLGAGTTRSPGSPPTLRVHGDTGSPRKPWPERRPPRPAATRTAPPTPSPGPSASPGPPGPALTSDSSRELTPHSALTSEATSDAPDTSPPTPDPASRTNPDLILTSPDFALSTPDSSVVPALTPEPSPTPLPTLPKELTSDPSTPSEVTSLSPTSEQVPESDTTPDLDTTPYSSTVSEYSRSPDPSPSPHPTTTPDPTMAPDPITTLNPTVTPHFPTTPHPTTTPHPTTITHSTMIPDPTTTPQPFTTITHSTMIPDPTTTPQPFTTMQPTTTPHSTTPHPTTTPHPTTITHSTMIPDPTTTPQPFTTMQPTTMPHPTTTPHPTTTPHPTTTPHPTTTPHPTMTPDPTTTPYPTTTPDPTTTPHPTTPDPSSTPVITTVSLPTSLGTELSSPTLAPTVKPSLHPQLTFTAPAPHTSTSQIPTLEPSPALESSPSRSSTATSMDPLSTEDFKPPRSQSPNLTPPPTHTPHSASDLTVSPDPLLSPTAHPLDHPPLDPLTLGPTPGQSPGPHGPCVAPTPPVRVMACEPPALVELVAAVRDVGGQLQRLTQVVEQERQERQALLLGLTQLVEAARGLGQLGEAVKRLAEMAWTTSMPAPTTTTPEEEERPLRGDV

SEQ ID NO: 76581 - protein, 951 aa, Homo sapiens
  Payload ID: 15288
  Gene Symbol: SSC5D
  Gene Name: scavenger receptor cysteine rich family, 5 domains
  Uniprot ID: A1L4H1
  ENSP ID: ENSP00000467252
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTEPEAGAPRGDAPRSRTARVAAPP

SEQ ID NO: 76582 - protein, 118 aa, Homo sapiens
  Payload ID: 15288
  Gene Symbol: SSC5D
  Gene Name: scavenger receptor cysteine rich family, 5 domains
  ENSP ID: ENSP00000467434
DAGAVCDGMPLGYVPPTAPTDSNNSTPREAASRPPSTMTSQAPGTAGVSPPPASPTVLWEPGPEAGPPGLDSISDPFSWSWIPGLGRDRDAWLPGELATKPSASVTASVLEKTTTKAP

SEQ ID NO: 76583 - protein, 90 aa, Homo sapiens
  Payload ID: 15288
  Gene Symbol: SSC5D
  Gene Name: scavenger receptor cysteine rich family, 5 domains
  ENSP ID: ENSP00000470226
MRVLACLLAALVGIQAVERLRLADGPHGCAGRLEVWHGGRWGTVCDDGWDLRDAAVACRQLGCGGALAAPGGAFFGEGAGPVWLSELACR

SEQ ID NO: 76584 - protein, 953 aa, Homo sapiens
  Payload ID: 15288
  Gene Symbol: SSC5D
  Gene Name: scavenger receptor cysteine rich family, 5 domains
  ENSP ID: ENSP00000478419
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTEPEAGLREVMLLVQGLPGLQRLPSP

SEQ ID NO: 76585 - protein, 901 aa, Homo sapiens
  Payload ID: 15289
  Gene Symbol: SLFN11
  Gene Name: schlafen family member 11
  Uniprot ID: Q7Z7L1
  ENSP ID: ENSP00000312402
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWSSGPFPEDRSVKPRLCSLSSSLYRRSETSVRSMDSREAFCFLKTKRKPKILEEGPFHKIHKGVYQELPNSDPADPNSDPADLIFQKDYLEYGEILPFPESQLVEFKQFSTKHFQEYVKRTIPEYVPAFANTGGGYLFIGVDDKSREVLGCAKENVDPDSLRRKIEQAIYKLPCVHFCQPQRPITFTLKIVNVLKRGELYGYACMIRVNPFCCAVFSEAPNSWIVEDKYVCSLTTEKWVGMMTDTDPDLLQLSEDFECQLSLSSGPPLSRPVYSKKGLEHKKELQQLLFSVPPGYLRYTPESLWRDLISEHRGLEELINKQMQPFFRGILIFSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRKTFLRENFEHIQHIVIDEAQNFRTEDGDWYGKAKSITRRAKGGPGILWIFLDYFQTSHLDCSGLPPLSDQYPREELTRIVRNADPIAKYLQKEMQVIRSNPSFNIPTGCLEVFPEAEWSQGVQGTLRIKKYLTVEQIMTCVADTCRRFFDRGYSPKDVAVLVSTAKEVEHYKYELLKAMRKKRVVQLSDACDMLGDHIVLDSVRRFSGLERSIVFGIHPRTADPAILPNVLICLASRAKQHLYIFPWGGH

SEQ ID NO: 76586 - protein, 901 aa, Homo sapiens; identical to SEQ ID NO: 76585
  Payload ID: 15289
  Gene Symbol: SLFN11
  Gene Name: schlafen family member 11
  Uniprot ID: Q7Z7L1
  ENSP ID: ENSP00000378067

SEQ ID NO: 76587 - protein, 111 aa, Homo sapiens
  Payload ID: 15289
  Gene Symbol: SLFN11
  Gene Name: schlafen family member 11
  ENSP ID: ENSP00000393615
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWS

SEQ ID NO: 76588 - protein, 90 aa, Homo sapiens
  Payload ID: 15289
  Gene Symbol: SLFN11
  Gene Name: schlafen family member 11
  ENSP ID: ENSP00000395140
MEANQCPLVVEPSYPDLVINVGEVTLGEENRKKLQKIQRDQEKERVMRAACALLNSGGGVIRMAKKVEHPVEMGLDLEQSLRELIQSSDL

SEQ ID NO: 76589 - protein, 90 aa, Homo sapiens; identical to SEQ ID NO: 76588
  Payload ID: 15289
  Gene Symbol: SLFN11
  Gene Name: schlafen family member 11
  ENSP ID: ENSP00000397454

SEQ ID NO: 76590 - protein, 123 aa, Homo sapiens
  Payload ID: 15289
  Gene Symbol: SLFN11
  Gene Name: schlafen family member 11
  ENSP ID: ENSP00000464806
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQGRCFYIFVKSWSSGPFPEDRSVKP

SEQ ID NO: 76591 - protein, 50 aa, Homo sapiens
  Payload ID: 15289
  Gene Symbol: SLFN11
  Gene Name: schlafen family member 11
  ENSP ID: ENSP00000465198
  MOD_RES (1)..(1): Any amino acid
XICRAETRKTFLRENFEHIQHIVIDEAQNFRTEDGDWYGKAKSITRRAKE

SEQ ID NO: 76592 - protein, 48 aa, Homo sapiens
  Payload ID: 15289
  Gene Symbol: SLFN11
  Gene Name: schlafen family member 11
  ENSP ID: ENSP00000465777
MEANQCPLVVEPSYPDLVINVGEVTLGEENRKKLQKIQRDQEKERVMR

SEQ ID NO: 76593 - protein, 100 aa, Homo sapiens
  Payload ID: 15289
  Gene Symbol: SLFN11
  Gene Name: schlafen family member 11
  ENSP ID: ENSP00000468095
MEANQCPLVVEPSYPDLVINVGEVTLGEENRKKLQKIQRDQEKERVMRAACALLNSGGGVIRMAKKVEHPVEMGLDLEQSLRELIQSSDLQAFFETKQQG

SEQ ID NO: 76594 - protein, 80 aa, Homo sapiens
  Payload ID: 15289
  Gene Symbol: SLFN11
  Gene Name: schlafen family member 11
  ENSP ID: ENSP00000468602
MEANQCPLVVEPSYPDLVINVGEVTLGEENRKKLQKIQRDQEKERVMRAACALLNSGGGVIRMAKKVEHPVEMGLDLEQS

SEQ ID NO: 76595 - protein, 578 aa, Homo sapiens
  Payload ID: 15290
  Gene Symbol: SLFN12
  Gene Name: schlafen family member 12
  Uniprot ID: Q8IYM2
  ENSP ID: ENSP00000302077
MNISVDLETNYAELVLDVGRVTLGENSRKKMKDCKLRKKQNESVSRAMCALLNSGGGVIKAEIENEDYSYTKDGIGLDLENSFSNILLFVPEYLDFMQNGNYFLIFVKSWSLNTSGLRITTLSSNLYKRDITSAKVMNATAALEFLKDMKKTRGRLYLRPELLAKRPCVDIQEENNMKALAGVFFDRTELDRKEKLTFTESTHVEIKNFSTEKLLQRIKEILPQYVSAFANTDGGYLFIGLNEDKEIIGFKAEMSDLDDLEREIEKSIRKMPVHHFCMEKKKINYSCKFLGVYDKGSLCGYVCALRVERFCCAVFAKEPDSWHVKDNRVMQLTRKEWIQFMVEAEPKFSSSYEEVISQINTSLPAPHSWPLLEWQRQRHHCPGLSGRITYTPENLCRKLFLQHEGLKQLICEEMDSVRKGSLIFSRSWSVDLGLQENHKVLCDALLISQDSPPVLYTFHMVQDEEFKGYSTQTALTLKQKLAKIGGYTKKVCVMTKIFYLSPEGMTSCQYDLRSQVIYPESYYFTRRKYLLKALFKALKRLKSLRDQFSFAENLYQIIGIDCFQKNDKKMFKSCRRLT

SEQ ID NO: 76596 - protein, 578 aa, Homo sapiens; identical to SEQ ID NO: 76595
  Payload ID: 15290
  Gene Symbol: SLFN12
  Gene Name: schlafen family member 12
  Uniprot ID: Q8IYM2
  ENSP ID: ENSP00000378063

SEQ ID NO: 76597 - protein, 578 aa, Homo sapiens; identical to SEQ ID NO: 76595
  Payload ID: 15290
  Gene Symbol: SLFN12
  Gene Name: schlafen family member 12
  Uniprot ID: Q8IYM2
  ENSP ID: ENSP00000394903

SEQ ID NO: 76598 - protein, 115 aa, Homo sapiens
  Payload ID: 15290
  Gene Symbol: SLFN12
  Gene Name: schlafen family member 12
  ENSP ID: ENSP00000398315
MNISVDLETNYAELVLDVGRVTLGENSRKKMKDCKLRKKQNESVSRAMCALLNSGGGVIKAEIENEDYSYTKDGIGLDLENSFSNILLFVPEYLDFMQNGNYFLIFVKSWSLNTS

SEQ ID NO: 76599 - protein, 69 aa, Homo sapiens
  Payload ID: 15290
  Gene Symbol: SLFN12
  Gene Name: schlafen family member 12
  ENSP ID: ENSP00000404175
MNISVDLETNYAELVLDVGRVTLGENSRKKMKDCKLRKKQNESVSRAMCALLNSGGGVIKAEIENEDYS

SEQ ID NO: 76600 - protein, 617 aa, Homo sapiens
  Payload ID: 15291
  Gene Symbol: SLFN12L
  Gene Name: schlafen family member 12-like
  Uniprot ID: Q6IEE8
  ENSP ID: ENSP00000354412
MAMKIMEKIRNVFHCEAHRILYICESQFLRNFIRKEFLRGNGLAAGKMNISIDLDTNYAELVLNVGRVTLGENNRKKMKDCQLRKQQNENVSRAVCALLNSGGGVIKAEVENKGYSYKKDGIGLDLENSFSNMLPFVPNFLDFMQNGNYFHIFVKSWSLETSGPQIATLSSSLYKRDVTSAKVMNASAALEFLKDMEKTGGRAYLRPEFPAKRACVDVQEESNMEALAADFFNRTELGYKEKLTFTESTHVEIKNFSTEKLLQRITEILPQYVSAFANTDGGYLFVGLNEDKEVIGFKAEKSYLTKLEEVTKNSIGKLPVHHFCVEKGTINYLCKFLGVYDKGRLCGYVYALRVERFCCAVFAKKPDSWHVKDNRVKQLTEKEWIQFMVDSEPVCEELPSPASTSSPVSQSYPLREYINFKIQPLRYHLPGLSEKITCAPKTFCRNLFSQHEGLKQLICEEMGSVNKGSLIFSRSWSLDLGLQENHKVLCDALLISQDKPPVLYTFHMVQDEEFKDYSTQTAQTLKQKLAKIGGYTKKVCVMTKIFYLSPEGKTSCQYDLNSQVIYPESYYWTTAQTMKDLEKALSNILPKENQIFLFVCLFRFCLFVCWFVCFFLR

SEQ ID NO: 76601 - protein, 588 aa, Homo sapiens
  Payload ID: 15291
  Gene Symbol: SLFN12L
  Gene Name: schlafen family member 12-like
  Uniprot ID: Q6IEE8
  ENSP ID: ENSP00000437635
MDLARKEFLRGNGLAAGKMNISIDLDTNYAELVLNVGRVTLGENNRKKMKDCQLRKQQNENVSRAVCALLNSGGGVIKAEVENKGYSYKKDGIGLDLENSFSNMLPFVPNFLDFMQNGNYFHIFVKSWSLETSGPQIATLSSSLYKRDVTSAKVMNASAALEFLKDMEKTGGRAYLRPEFPAKRACVDVQEESNMEALAADFFNRTELGYKEKLTFTESTHVEIKNFSTEKLLQRITEILPQYVSAFANTDGGYLFVGLNEDKEVIGFKAEKSYLTKLEEVTKNSIGKLPVHHFCVEKGTINYLCKFLGVYDKGRLCGYVYALRVERFCCAVFAKKPDSWHVKDNRVKQLTEKEWIQFMVDSEPVCEELPSPASTSSPVSQSYPLREYINFKIQPLRYHLPGLSEKITCAPKTFCRNLFSQHEGLKQLICEEMGSVNKGSLIFSRSWSLDLGLQENHKVLCDALLISQDKPPVLYTFHMVQDEEFKDYSTQTAQTLKQKLAKIGGYTKKVCVMTKIFYLSPEGKTSCQYDLNSQVIYPESYYWTTAQTMKDLEKALSNILPKENQIFLFVCLFRFCLFVCWFVCFFLR

SEQ ID NO: 76602 - protein, 588 aa, Homo sapiens
  Payload ID: 15291
  Gene Symbol: SLFN12L
  Gene Name: schlafen family member 12-like
  ENSP ID: ENSP00000487397
DLLKRKEFLRGNGLAAGKMNISIDLDTNYAELVLNVGRVTLGENNRKKMKDCQLRKQQNENVSRAVCALLNSGGGVIKAEVENKGYSYKKDGIGLDLENSFSNMLPFVPNFLDFMQNGNYFHIFVKSWSLETSGPQIATLSSSLYKRDVTSAKVMNASAALEFLKDMEKTGGRAYLRPEFPAKRACVDVQEESNMEALAADFFNRTELGYKEKLTFTESTHVEIKNFSTEKLLQRITEILPQYVSAFANTDGGYLFVGLNEDKEVIGFKAEKSYLTKLEEVTKNSIGKLPVHHFCVEKGTINYLCKFLGVYDKGRLCGYVYALRVERFCCAVFAKKPDSWHVKDNRVKQLTEKEWIQFMVDSEPVCEELPSPASTSSPVSQSYPLREYINFKIQPLRYHLPGLSEKITCAPKTFCRNLFSQHEGLKQLICEEMGSVNKGSLIFSRSWSLDLGLQENHKVLCDALLISQDKPPVLYTFHMVQDEEFKDYSTQTAQTLKQKLAKIGGYTKKVCVMTKIFYLSPEGKTSCQYDLNSQVIYPESYYWTTAQTMKDLEKALSNILPKENQIFLFVCLFRFCLFVCWFVCFFLR

SEQ ID NO: 76603 - protein, 897 aa, Homo sapiens
  Payload ID: 15292
  Gene Symbol: SLFN13
  Gene Name: schlafen family member 13
  Uniprot ID: Q68D06
  ENSP ID: ENSP00000285013
MEANHCSLGVYPSYPDLVIDVGEVTLGEENRKKLQKTQRDQERARVIRAACALLNSGGGVIQMEMANRDERPTEMGLDLEESLRKLIQYPYLQAFFETKQHGRCFYIFVKSWSGDPFLKDGSFNSRICSLSSSLYCRSGTSVLHMNSRQAFDFLKTKERQSKYNLINEGSPPSKIMKAVYQNISESNPAYEVFQTDTIEYGEILSFPESPSIEFKQFSTKHIQQYVENIIPEYISAFANTEGGYLFIGVDDKSRKVLGCAKEQVDPDSLKNVIARAISKLPIVHFCSSKPRVEYSTKIVEVFCGKELYGYLCVIKVKAFCCVVFSEAPKSWMVREKYIRPLTTEEWVEKMMDADPEFPPDFAEAFESQLSLSDSPSLCRPVYSKKGLEHKADLQQHLFPVPPGHLECTPESLWKELSLQHEGLKELIHKQMRPFSQGIVILSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRETFLREKFEHIQHIVIDEAQNFRTEDGDWYRKAKTITQREKDCPGVLWIFLDYFQTSHLGHSGLPPLSAQYPREELTRVVRNADEIAEYIQQEMQLIIENPPINIPHGYLAILSEAKWVPGVPGNTKIIKNFTLEQIVTYVADTCRCFFERGYSPKDVAVLVSTVTEVEQYQSKLLKAMRKKMVVQLSDACDMLGVHIVLDSVRRFSGLERSIVFGIHPRTADPAILPNILICLASRAKQHLYIFL

SEQ ID NO: 76604 - protein, 106 aa, Homo sapiens
  Payload ID: 15292
  Gene Symbol: SLFN13
  Gene Name: schlafen family member 13
  ENSP ID: ENSP00000433181
MEANHCSLGVYPSYPDLVIDVGEVTLGEENRKKLQKTQRDQERARVIRAACALLNSGGGVIQMEMANRDERPTEMGLDLEESLRKLIQYPYLQAFFETKQHGRCFY

SEQ ID NO: 76605 - protein, 897 aa, Homo sapiens; identical to SEQ ID NO: 76603
  Payload ID: 15292
  Gene Symbol: SLFN13
  Gene Name: schlafen family member 13
  Uniprot ID: Q68D06
  ENSP ID: ENSP00000434439

SEQ ID NO: 76606 - protein, 130 aa, Homo sapiens
  Payload ID: 15292
  Gene Symbol: SLFN13
  Gene Name: schlafen family member 13
  ENSP ID: ENSP00000435328
MVREKYIRPLTTEEWVEKMMDADPEFPPDFAEAFESQLSLSDSPSLCRPVYSKKGLEHKADLQQHLFPVPPGHLECTPESLWKELSLQHEGLKELIHKQMRPFSQGIVILSRSWAVDLNLQEKPGVICDA

SEQ ID NO: 76607 - protein, 579 aa, Homo sapiens
  Payload ID: 15292
  Gene Symbol: SLFN13
  Gene Name: schlafen family member 13
  Uniprot ID: Q68D06
  ENSP ID: ENSP00000435442
MEANHCSLAPKSWMVREKYIRPLTTEEWVEKMMDADPEFPPDFAEAFESQLSLSDSPSLCRPVYSKKGLEHKADLQQHLFPVPPGHLECTPESLWKELSLQHEGLKELIHKQMRPFSQGIVILSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRETFLREKFEHIQHIVIDEAQNFRTEDGDWYRKAKTITQREKDCPGVLWIFLDYFQTSHLGHSGLPPLSAQYPREELTRVVRNADEIAEYIQQEMQLIIENPPINIPHGYLAILSEAKWVPGVPGNTKIIKNFTLEQIVTYVADTCRCFFERGYSPKDVAVLVSTVTEVEQYQSKLLKAMRKKMVVQLSDACDMLGVHIVLDSVRRFSGLERSIVFGIHPRTADPAILPNILICLASRAKQHLYIFL

SEQ ID NO: 76608 - protein, 119 aa, Homo sapiens
  Payload ID: 15292
  Gene Symbol: SLFN13
  Gene Name: schlafen family member 13
  ENSP ID: ENSP00000437298
MEANHCSLGVYPSYPDLVIDVGEVTLGEENRKKLQKTQRDQERARVIRAACALLNSGGGVIQMEMANRDERPTEMGLDLEESLRKLIQYPYLQAFFETKQHGSSQVMDGEGEVHPPLDN

SEQ ID NO: 76609 - protein, 897 aa, Homo sapiens; identical to SEQ ID NO: 76603
  Payload ID: 15292
  Gene Symbol: SLFN13
  Gene Name: schlafen family member 13
  Uniprot ID: Q68D06
  ENSP ID: ENSP00000444016

SEQ ID NO: 76610 - protein, 897 aa, Homo sapiens; identical to SEQ ID NO: 76603
  Payload ID: 15292
  Gene Symbol: SLFN13
  Gene Name: schlafen family member 13
  Uniprot ID: Q68D06
  ENSP ID: ENSP00000467426

SEQ ID NO: 76611 - protein, 77 aa, Homo sapiens
  Payload ID: 15292
  Gene Symbol: SLFN13
  Gene Name: schlafen family member 13
  ENSP ID: ENSP00000467557
MEANHCSLGVYPSYPDLVIDVGEVTLGEENRKKLQKTQRDQERARVIRAACALLNSGGGVIQMEMANRDERPTEMGL

SEQ ID NO: 76612 - protein, 912 aa, Homo sapiens
  Payload ID: 15293
  Gene Symbol: SLFN14
  Gene Name: schlafen family member 14
  Uniprot ID: P0C7P3
  ENSP ID: ENSP00000391101
MESLKTDTEMPYPEVIVDVGRVIFGEENRKKMTNSCLKRSENSRIIRAICALLNSGGGVIKAEIDDKTYSYQCHGLGQDLETSFQKLLPSGSQKYLDYMQQGHNLLIFVKSWSPDVFSLPLRICSLRSNLYRRDVTSAINLSASSALELLREKGFRAQRGRPRVKKLHPQQVLNRCIQEEEDMRILASEFFKKDKLMYKEKLNFTESTHVEFKRFTTKKVIPRIKEMLPHYVSAFANTQGGYVLIGVDDKSKEVVGCKWEKVNPDLLKKEIENCIEKLPTFHFCCEKPKVNFTTKILNVYQKDVLDGYVCVIQVEPFCCVVFAEAPDSWIMKDNSVTRLTAEQWVVMMLDTQSAPPSLVTDYNSCLISSASSARKSPGYPIKVHKFKEALQRHLFPVTQEEVQFKPESLCKKLFSDHKELEGLMKTLIHPCSQGIVIFSRSWAGDVGFRKEQNVLCDALLIAVNSPVVLYTILIDPNWPGGLEYARNTAHQLKQKLQTVGGYTGKVCIIPRLIHLSSTQSRPGEIPLRYPRSYRLADEEEMEDLLQALVVVSLSSRSLLSDQMGCEFFNLLIMEQSQLLSESLQKTRELFIYCFPGVRKTALAIKIMEKIKDLFHCKPKEILYVCESDSLKDFVTQQTTCQAVTRKTFMQGEFLKIKHIVMDETENFCSKYGNWYMKAKNITHPKAKGTGSENLHHGILWLFLDPFQIHHADVNGLPPPSAQFPRKTITSGIHCALEIAKVMKEEMKRIKENPPSNMSPDTLALFSETAYEEATCAQALPGVCETKTNLTTEQIANYVARKCHSLFQCGYLPKDIAILCRRGEDRGRYRLALLKAMELIETHRPSEVVFSPATGVWGSHIVLDSIQQFSGLERTVVFGLSPECDQSEEFHKLCFASRAIKHLYLLYEKRAAY

SEQ ID NO: 76613 - protein, 891 aa, Homo sapiens
  Payload ID: 15294
  Gene Symbol: SLFN5
  Gene Name: schlafen family member 5
  Uniprot ID: Q08AF3
  ENSP ID: ENSP00000299977
MSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKEKIDLTSLRASIDGCIKKLPVHHFCTQRPEIKYVLNFLEVHDKGALRGYVCAIKVEKFCCAVFAKVPSSWQVKDNRVRQLPTREWTAWMMEADPDLSRCPEMVLQLSLSSATPRSKPVCIHKNSECLKEQQKRYFPVFSDRVVYTPESLYKELFSQHKGLRDLINTEMRPFSQGILIFSQSWAVDLGLQEKQGVICDALLISQNNTPILYTIFSKWDAGCKGYSMIVAYSLKQKLVNKGGYTGRLCITPLVCVLNSDRKAQSVYSSYLQIYPESYNFMTPQHMEALLQSLVIVLLGFKSFLSEELGSEVLNLLTNKQYELLSKNLRKTRELFVHGLPGSGKTILALRIMEKIRNVFHCEPANILYICENQPLKKLVSFSKKNICQPVTRKTFMKNNFEHIQHIIIDDAQNFRTEDGDWYGKAKFITQTARDGPGVLWIFLDYFQTYHLSCSGLPPPSDQYPREEINRVVRNAGPIANYLQQVMQEARQNPPPNLPPGSLVMLYEPKWAQGVPGNLEIIEDLNLEEILIYVANKCRFLLRNGYSPKDIAVLFTKASEVEKYKDRLLTAMRKRKLSQLHEESDLLLQIGDASDVLTDHIVLDSVCRFSGLERNIVFGINPGVAPPAGAYNLLLCLASRAKRHLYILKASV

SEQ ID NO: 76614 - protein, 389 aa, Homo sapiens
  Payload ID: 15294
  Gene Symbol: SLFN5
  Gene Name: schlafen family member 5
  ENSP ID: ENSP00000440537
MSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKEKIDLTSLRASIDGCIKKLPVHHFCTQRPEIKYVLNFLEVHDKGALRGYVCAIKVEKFCCAVFAKVPSSWQVKDNRVRQLPTREWTAWMMEADPDLSRCPEMVLQLSLSSATPRSKPVCIHKNSECLKEQQKRYFPVSARKTSASQ

SEQ ID NO: 76615 - protein, 338 aa, Homo sapiens
  Payload ID: 15294
  Gene Symbol: SLFN5
  Gene Name: schlafen family member 5
  Uniprot ID: Q08AF3
  ENSP ID: ENSP00000466984
MSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKEKIDLTSLRASIDGCIKKLPVHHFCTQRPEIKYVLNFLEVHDKGALRGYVCAIKVEKFCCAVFAKVPSSWQVKDNRVRQLPTREWTAWMMEADPG

SEQ ID NO: 76616 - protein, 407 aa, Homo sapiens
  Payload ID: 15295
  Gene Symbol: SLFNL1
  Gene Name: schlafen-like 1
  Uniprot ID: Q499Z3
  ENSP ID: ENSP00000304401
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREEKEEEEEDSGLSPGPSPGSGVPLPTWPTHTLPDRPQAQQLQSCQGRPSGVCSDSAIVHQQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVIRLTVHTPKAQSQPQLYQTDQGEVFLRRDGSIQGPLSASAIQEWCRQRWLVELGKLEEKMKALMMEKEQLQQQLQQHGPVSCTCCVL

SEQ ID NO: 76617 - protein, 407 aa, Homo sapiens; identical to SEQ ID NO: 76616
  Payload ID: 15295
  Gene Symbol: SLFNL1
  Gene Name: schlafen-like 1
  Uniprot ID: Q499Z3
  ENSP ID: ENSP00000352299

SEQ ID NO: 76618 - protein, 348 aa, Homo sapiens
  Payload ID: 15295
  Gene Symbol: SLFNL1
  Gene Name: schlafen-like 1
  Uniprot ID: Q499Z3
  ENSP ID: ENSP00000361694
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVIRLTVHTPKAQSQPQLYQTDQGEVFLRRDGSIQGPLSASAIQEWCRQRWLVELGKLEEKMKALMMEKEQLQQQLQQHGPVSCTCCVL

SEQ ID NO: 76619 - protein, 359 aa, Homo sapiens
  Payload ID: 15295
  Gene Symbol: SLFNL1
  Gene Name: schlafen-like 1
  Uniprot ID: Q499Z3
  ENSP ID: ENSP00000361696
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREEKEEEEEDSGLSPGPSPGSGVPLPTWPTHTLPDRPQAQQLQSCQGRPSGVCSDSAIVHQQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKRWLVELGKLEEKMKALMMEKEQLQQQLQQHGPVSCTCCVL

SEQ ID NO: 76620 - protein, 407 aa, Homo sapiens; identical to SEQ ID NO: 76616
  Payload ID: 15295
  Gene Symbol: SLFNL1
  Gene Name: schlafen-like 1
  Uniprot ID: Q499Z3
  ENSP ID: ENSP00000398938

SEQ ID NO: 76621 - protein, 244 aa, Homo sapiens
  Payload ID: 15296
  Gene Symbol: SCHIP1
  Gene Name: schwannomin interacting protein 1
  Uniprot ID: Q9P0W5
  ENSP ID: ENSP00000404860
MVHQDNCSYQAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 76622 - protein, 260 aa, Homo sapiens
  Payload ID: 15296
  Gene Symbol: SCHIP1
  Gene Name: schwannomin interacting protein 1
  ENSP ID: ENSP00000419230
MNLDSDGMDDIISQESSLDMEGNYKKAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 76623 - protein, 52 aa, Homo sapiens
  Payload ID: 15296
  Gene Symbol: SCHIP1
  Gene Name: schwannomin interacting protein 1
  ENSP ID: ENSP00000420376
MVHQDNCSYQAQKNERESIRQKLALGSFFDDGPGIYTSCSKSGKPSLSSRLE

SEQ ID NO: 76624 - protein, 688 aa, Homo sapiens
  Payload ID: 15297
  Gene Symbol: SCEL
  Gene Name: sciellin
  Uniprot ID: O95171
  ENSP ID: ENSP00000302579
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNIRSQDLDNIVKVATSLQRSDKGEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGKKDLDGLIKVDPETNKNITRGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 76625 - protein, 668 aa, Homo sapiens
  Payload ID: 15297
  Gene Symbol: SCEL
  Gene Name: sciellin
  Uniprot ID: O95171
  ENSP ID: ENSP00000366454
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGKKDLDGLIKVDPETNKNITRGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 76626 - protein, 283 aa, Homo sapiens
  Payload ID: 15297
  Gene Symbol: SCEL
  Gene Name: sciellin
  ENSP ID: ENSP00000432840
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRSMSMFRSLEVTKLQPGGSLNANTSNTIASTSATTPVKKKRQSWFPPPPPGYNASSSTGTRRREPGVHPPIPPKPSSPVSSPNQLRQDNRQIHPPKPGVYTETNRSAERNISEELDNLIKMNKSLNRNQGLDSLFRANPKVEEREKRAKSLESLIYMSTRTDKDGKGIQSLGSPIKVNQRTDKNEKG

SEQ ID NO: 76627 - protein, 646 aa, Homo sapiens
  Payload ID: 15297
  Gene Symbol: SCEL
  Gene Name: sciellin
  Uniprot ID: O95171
  ENSP ID: ENSP00000437895
MSNVTLRKMSPTGNEMKSTTQGTTRKQQDFHEVNKRRTFLQDNSWIKKRPEEEKDENYGRVVLNRHNSHDALDRKVNERDVPKATISRYSSDDTLDRISDRNDAAKTYKANTLDNQLTNRSMSMFRSLEVTKLQPGGSLNANTSNTIASTSATTPVKKKREPGVHPPIPPKPSSPVSSPNQLRQDNRQIHPPKPGVYTETNRSAERNIRSQDLDNIVKVATSLQRSDKGEELDNLIKMNKSLNRNQGLDSLFRANPKVEEREKRAKSLESLIYMSTRTDKDGKGIQSLGSPIKVNQRTDKNEKGRQNLESVAKVNARMNKTSRRSEDLDNATEVNPKGHENTTGGQSLDNLIKVTPEVKRSNQGSKDLNNFIKVYPGTEKSTEGGQSLDSLIKVTPERNRTNQGNQDLENLIKVIPSANKSSEQGLDEHINVSPKAVKNTDGKQDLDKLIKVNPEIFTNNQRNQDLANLIKVNPAVIRNNQSQDLDNLIKVKPSALRNTNRDQNLENLIEVNSHVSENKNGSSNTGAKQAGPQDTVVYTRTYVENSKSPKDGYQENISGKYIQTVYSTSDRSVIERDMCTYCRKPLGVETKMILDELQICCHSTCFKCEICKQPLENLQAGDSIWIYRQTIHCEPCYSKIMAKWIP

SEQ ID NO: 76628 - protein, 715 aa, Homo sapiens
  Payload ID: 15298
  Gene Symbol: SCIN
  Gene Name: scinderin
  Uniprot ID: Q9Y6U3
  ENSP ID: ENSP00000297029
MARELYHEEFARAGKQAGLQVWRIEKLELVPVPQSAHGDFYVGDAYLVLHTAKTSRGFTYHLHFWLGKECSQDESTAAAIFTVQMDDYLGGKPVQNRELQGYESNDFVSYFKGGLKYKAGGVASGLNHVLTNDLTAKRLLHVKGRRVVRATEVPLSWDSFNKGDCFIIDLGTEIYQWCGSSCNKYERLKANQVATGIRYNERKGRSELIVVEEGSEPSELIKVLGEKPELPDGGDDDDIIADISNRKMAKLYMVSDASGSMRVTVVAEENPFSMAMLLSEECFILDHGAAKQIFVWKGKDANPQERKAAMKTAEEFLQQMNYSKNTQIQVLPEGGETPIFKQFFKDWRDKDQSDGFGKVYVTEKVAQIKQIPFDASKLHSSPQMAAQHNMVDDGSGKVEIWRVENNGRIQVDQNSYGEFYGGDCYIILYTYPRGQIIYTWQGANATRDELTTSAFLTVQLDRSLGGQAVQIRVSQGKEPVHLLSLFKDKPLIIYKNGTSKKGGQAPAPPTRLFQVRRNLASITRIVEVDVDANSLNSNDVFVLKLPQNSGYIWVGKGASQEEEKGAEYVASVLKCKTLRIQEGEEPEEFWNSLGGKKDYQTSPLLETQAEDHPPRLYGCSNKTGRFVIEEIPGEFTQDDLAEDDVMLLDAWEQIFIWIGKDANEVEKKESLKSAKMYLETDPSGRDKRTPIVIIKQGHEPPTFTGWFLGWDSSKW

SEQ ID NO: 76629 - protein, 580 aa, Homo sapiens
  Payload ID: 15298
  Gene Symbol: SCIN
  Gene Name: scinderin
  Uniprot ID: Q9Y6U3
  ENSP ID: ENSP00000341375
MARELYHEEFARAGKQAGLQVWRIEKLELVPVPQSAHGDFYVGDAYLVLHTAKTSRGFTYHLHFWLGKECSQDESTAAAIFTVQMDDYLGGKPVQNRELQGYESNDFVSYFKGGLKYKAGGVASGLNHVLTNDLTAKRLLHVKGRRVVRATEVPLSWDSFNKGDCFIIDLGTEIYQWCGSSCNKYERLKANQVATGIRYNERKGRSELIVVEEGSEPSELIKVLGEKPELPDGGDDDDIIADISNRKMAKLYMVSDASGSMRVTVVAEENPFSMAMLLSEECFILDHGAAKQIFVWKGKDANPQERKAAMKTAEEFLQQMNYSKNTQIQVLPEGGETPIFKQFFKDWRDKDQSDGFGKVYVTEKVAQIKQIPFDASKLHSSPQMAAQHNMVDDGSGKVEIWRVENNGRIQVDQNSYGEFYGGDCYIILYTYPRGQIIYTWQGANATRDELTTSAFLTVQLDRSLGGQAVQIRVSQGKEPVHLLSLFKDKPLIIYKNGTSKKGGQAPAPPTRLFQVRRNLASITRIVERSSGIPLEGKKTTRPHHYWKPRLKTIHLGFTAALTKLEDLLLKRFQESSPRMI

SEQ ID NO: 76630 - protein, 160 aa, Homo sapiens
  Payload ID: 15298
  Gene Symbol: SCIN
  Gene Name: scinderin
  ENSP ID: ENSP00000404380
MARELYHEEFARAGKQAGLQVWRIEKLELVPVPQSAHGDFYVGDAYLVLHTAKTSRGFTYHLHFWLGFYPHHAACGSGRQKLRFIRKLASSDRRKECSQDESTAAAIFTVQMDDYLGGKPVQNRELQGYESNDFVSYFKGGLKYKAGGVASGLNHVLTND

SEQ ID NO: 76631 - protein, 102 aa, Homo sapiens
  Payload ID: 15298
  Gene Symbol: SCIN
  Gene Name: scinderin
  ENSP ID: ENSP00000411149
MARELYHEEFARAGKQAGLQVWRIEKLELVPVPQSAHGDFYVGDAYLVLHTAKTSRGFTYHLHFWLGIGKSRNKNRPGMVAHTCNPQQFRRPKPEDCLRPGV

SEQ ID NO: 76632 - protein, 91 aa, Homo sapiens
  Payload ID: 15298
  Gene Symbol: SCIN
  Gene Name: scinderin
  ENSP ID: ENSP00000428555
MASLMSAFTLVQQEIYQWCGSSCNKYERLKANQVATGIRYNERKGRSELIVVEEGSEPSELIKVLGEKPELPDGGDDDDIIADISNRKMAK

SEQ ID NO: 76633 - protein, 108 aa, Homo sapiens
  Payload ID: 15298
  Gene Symbol: SCIN
  Gene Name: scinderin
  ENSP ID: ENSP00000429598
MASLMSAFTLVQQEIYQWCGSSCNKYERLKANQVATGIRYNERKGRSELIVVEEGSEPSELIKVLGEKPELPDGGDDDDIIADISNRKMAKLYMVSDASGSMRVTVVA

SEQ ID NO: 76634 - protein, 468 aa, Homo sapiens
  Payload ID: 15298
  Gene Symbol: SCIN
  Gene Name: scinderin
  Uniprot ID: Q9Y6U3
  ENSP ID: ENSP00000430997
MAKLYMVSDASGSMRVTVVAEENPFSMAMLLSEECFILDHGAAKQIFVWKGKDANPQERKAAMKTAEEFLQQMNYSKNTQIQVLPEGGETPIFKQFFKDWRDKDQSDGFGKVYVTEKVAQIKQIPFDASKLHSSPQMAAQHNMVDDGSGKVEIWRVENNGRIQVDQNSYGEFYGGDCYIILYTYPRGQIIYTWQGANATRDELTTSAFLTVQLDRSLGGQAVQIRVSQGKEPVHLLSLFKDKPLIIYKNGTSKKGGQAPAPPTRLFQVRRNLASITRIVEVDVDANSLNSNDVFVLKLPQNSGYIWVGKGASQEEEKGAEYVASVLKCKTLRIQEGEEPEEFWNSLGGKKDYQTSPLLETQAEDHPPRLYGCSNKTGRFVIEEIPGEFTQDDLAEDDVMLLDAWEQIFIWIGKDANEVEKKESLKSAKMYLETDPSGRDKRTPIVIIKQGHEPPTFTGWFLGWDSSKW

SEQ ID NO: 76635 - protein, 1241 aa, Homo sapiens
  Payload ID: 15299
  Gene Symbol: STIL
  Gene Name: SCL/TAL1 interrupting locus
  ENSP ID: ENSP00000337367
MEPIYPFARPQMNTRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNSSSLVVRKEPDVPVFFPSGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 76636 - protein, 1287 aa, Homo sapiens
  Payload ID: 15299
  Gene Symbol: STIL
  Gene Name: SCL/TAL1 interrupting locus
  Uniprot ID: Q15468
  ENSP ID: ENSP00000353544
MEPIYPFARPQMNTRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNSSLVVRKEPDVPVFFPSGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 76637 - protein, 1288 aa, Homo sapiens
  Payload ID: 15299
  Gene Symbol: STIL
  Gene Name: SCL/TAL1 interrupting locus
  Uniprot ID: Q15468
  ENSP ID: ENSP00000360944
MEPIYPFARPQMNTRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNSSSLVVRKEPDVPVFFPSGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 76638 - protein, 1270 aa, Homo sapiens
  Payload ID: 15299
  Gene Symbol: STIL
  Gene Name: SCL/TAL1 interrupting locus
  ENSP ID: ENSP00000379523
MEPIYPFARPQMNTRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCGKLLSLRVHITSRESLDSVEFDLHWAAVTLANNFKCTPVKPIPIIPTALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNGQLAESVSMCLQTGPTGGASNNSETSEEPKIEHVMQPLLHQPSDNQKIYQDLLGQVNHLLNSSSKETEQPSTKAVIISHECTRTQNVYHTKKKTHHSRLVDKDCVLNATLKQLRSLGVKIDSPTKVKKNAHNVDHASVLACISPEAVISGLNCMSFANVGMSGLSPNGVDLSMEANAIALKYLNENQLSQLSVTRSNQNNCDPFSLLHINTDRSTVGLSLISPNNMSFATKKYMKRYGLLQSSDNSEDEEEPPDNADSKSEYLLNQNLRSIPEQLGGQKEPSKNDHEIINCSNCESVGTNADTPVLRNITNEVLQTKAKQQLTEKPAFLVKNLKPSPAVNLRTGKAEFTQHPEKENEGDITIFPESLQPSETLKQMNSMNSVGTFLDVKRLRQLPKLF

SEQ ID NO: 76639 - protein, 211 aa, Homo sapiens
  Payload ID: 15299
  Gene Symbol: STIL
  Gene Name: SCL/TAL1 interrupting locus
  ENSP ID: ENSP00000409087
  MOD_RES (1)..(1): Any amino acid
XQLYDEKHSPEVEAGEPSLRGIPNQLNQDKPALLRHCKPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVS

SEQ ID NO: 76640 - protein, 918 aa, Homo sapiens
  Payload ID: 15299
  Gene Symbol: STIL
  Gene Name: SCL/TAL1 interrupting locus
  ENSP ID: ENSP00000411664
MEPIYPFARPQMNTRFPSSRMVPFHFPPSKCALWNPTPTGDFIYLHLSYYRNPKLVVTEKTIRLAYRHAKQNKKNSSCFLLGSLTADEDEEGVTLTVDRFDPGREVPECLEITPTASLPGDFLIPCKVHTQELCSREMIVHSVDDFSSALKALQCHICSKDSLDCALARNLSSNLNISQVQGTYKYGYLTMDETRKLLLLLESDPKVYSLPLVGIWLSGITHIYSPQVWACCLRYIFNSSVQERVFSESGNFIIVLYSMTHKEPEFYECFPCDGKIPDFRFQLLTSKETLHLFKNVEPPDKNPIRCELSAESQNAETEFFSKASKNFSIKRSSQKLSSGKMPIHDHDSGVEDEDFSPRPIPSPHPVSQKISKIQPSVPELSLVLDGNFIESNPLPTPLEMVNNENPPLINHLEHLKPLQPQLYDEKHSPEVEAGEPSLRGIPNQLNQDKPALLRHCKVRQPPAYKKGNPHTRNSIKPSSHNGPSHDIFEKLQTVSAGNVQNEEYPIRPSTLNSRQSSLAPQSQPHDFVFSPHNSGRPMELQIPTPPLPSYCSTNVCRCCQHHSHIQYSPLNSWQGANTVGSIQDVQSEALQKHSLFHPSGCPALYCNAFCSSSSPIALRPQGDMGSCSPHSNIEPSPVARPPSHMDLCNPQPCTVCMHTPKTESDNGMMGLSPDAYRFLTEQDRQLRLLQAQIQRLLEAQSLMPCSPKTTAVEDTVQAGRQMELVSVEAQSSPGLHMRKGVSIAVSTGASLFWNAAGEDQEPDSQMKQDDTKISSEDMNFSVDINNEVTSLPGSASSLKAVDIPSFEESNIAVEEEFNQPLSVSNGQLAESVSMCLQTGPTGGASNNSETSEEPKIEHVMQPLLHQPSDNQKIYQDLLGQVNHLLNSSSKETEQPSTKAVIISHECTRTQNVYHTKKK

SEQ ID NO: 76641 - protein, 92 aa, Homo sapiens
  Payload ID: 15299
  Gene Symbol: STIL
  Gene Name: SCL/TAL1 interrupting locus
  ENSP ID: ENSP00000412019
MSTKFAIPCALILHCFFKRFPSSRMVPFHFPPSKCALWNPTPTGDFIYLHLSYYRNPKLVVTEKTIRLAYRHAKQNKKNSSCFLLGSLTADE

SEQ ID NO: 76642 - protein, 201 aa, Homo sapiens
  Payload ID: 15300
  Gene Symbol: SCX
  Gene Name: scleraxis bHLH transcription factor
  Uniprot ID: Q7RTU7
  ENSP ID: ENSP00000476384
MSFATLRPAPPGRYLYPEVSPLSEDEDRGSDSSGSDEKPCRVHAARCGLQGARRRAGGRRAGGGGPGGRPGREPRQRHTANARERDRTNSVNTAFTALRTLIPTEPADRKLSKIETLRLASSYISHLGNVLLAGEACGDGQPCHSGPAFFHAARAGSPPPPPPPPPARDGENTQPKQICTFCLSNQRKLSKDRDRKTAIRS

SEQ ID NO: 76643 - protein, 213 aa, Homo sapiens
  Payload ID: 15301
  Gene Symbol: SOST
  Gene Name: sclerostin
  Uniprot ID: Q9BQB4
  ENSP ID: ENSP00000301691
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 76644 - protein, 206 aa, Homo sapiens
  Payload ID: 15302
  Gene Symbol: SOSTDC1
  Gene Name: sclerostin domain containing 1
  Uniprot ID: Q6X4U4
  ENSP ID: ENSP00000304930
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 76645 - protein, 230 aa, Homo sapiens
  Payload ID: 15302
  Gene Symbol: SOSTDC1
  Gene Name: sclerostin domain containing 1
  Uniprot ID: Q6X4U4
  ENSP ID: ENSP00000379889
MLPPAIHFYLLPLACILMKSCLAFKNDATEILYSHVVKPVPAHPSSNSTLNQARNGGRHFSNTGLDRNRTESLTRQNYFWLFPGAFLRQLQEARVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 76646 - protein, 866 aa, Homo sapiens
  Payload ID: 15303
  Gene Symbol: SFMBT1
  Gene Name: Scm-like with four mbt domains 1
  Uniprot ID: Q9UHJ3
  ENSP ID: ENSP00000378235
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIRIEVAERLHLDSNPLKWSVADVVRFIRSTDCAPLARIFLDQEIDGQALLLLTLPTVQECMDLKLGPAIKLCHHIERIKFAFYEQFAN

SEQ ID NO: 76647 - protein, 121 aa, Homo sapiens
  Payload ID: 15303
  Gene Symbol: SFMBT1
  Gene Name: Scm-like with four mbt domains 1
  ENSP ID: ENSP00000418860
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPE

SEQ ID NO: 76648 - protein, 94 aa, Homo sapiens
  Payload ID: 15303
  Gene Symbol: SFMBT1
  Gene Name: Scm-like with four mbt domains 1
  ENSP ID: ENSP00000418950
MNGEQQLDADAGSGMEEVELSWEDYLEETGSTAVPYGSFKHVDTRLQNGFAPGMKLEVAVRTDPETYWVATVITTCEQLLLLRYDGYGEDRRAD

SEQ ID NO: 76649 - protein, 50 aa, Homo sapiens
  Payload ID: 15303
  Gene Symbol: SFMBT1
  Gene Name: Scm-like with four mbt domains 1
  ENSP ID: ENSP00000419215
MNGEQQLDADAGSGMEEVELSWEDYLEETGSTAVPYGSFKHVDTRLQNGF

SEQ ID NO: 76650 - protein, 894 aa, Homo sapiens
  Payload ID: 15304
  Gene Symbol: SFMBT2
  Gene Name: Scm-like with four mbt domains 2
  Uniprot ID: Q5VUG0
  ENSP ID: ENSP00000355109
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDAIKEKYTDWTEFLIRDLTGSRTAPANLLEGPLRGKGPIDLITVGSLIELQDSQNPFQYWIVSVIENVGGRLRLRYVGLEDTESYDQWLFYLDYRLRPVGWCQENKYRMDPPSEIYPLKMASEWKCTLEKSLIDAAKFPLPMEVFKDHADLRSHFFTVGMKLETVNMCEPFYISPASVTKVFNNHFFQVTIDDLRPEPSKLSMLCHADSLGILPVQWCLKNGVSLTPPKGYSGQDFDWADYHKQHGAQEAPPFCFRNTSFSRGFTKNMKLEAVNPRNPGELCVASVVSVKGRLMWLHLEGLQTPVPEVIVDVESMDIFPVGWCEANSYPLTAPHKTVSQKKRKIAVVQPEKQLPPTVPVKKIPHDLCLFPHLDTTGTVNGKYCCPQLFINHRCFSGPYLNKGRIAELPQSVGPGKCVLVLKEVLSMIINAAYKPGRVLRELQLVEDPHWNFQEETLKAKYRGKTYRAVVKIVRTSDQVANFCRRVCAKLECCPNLFSPVLISENCPENCSIHTKTKYTYYYGKRKKISKPPIGESNPDSGHPKPARRRKRRKSIFVQKKRRSSAVDFTAGSGEESEEEDADAMDDDTASEETGSELRDDQTDTSSAEVPSARPRRAVTLRSGSEPVRRPPPERTRRGRGAPAASSAEEGEKCPPTKPEGTEDTKQEEEERLVLESNPLEWTVTDVVRFIKLTDCAPLAKIFQEQDIDGQALLLLTLPTVQECMELKLGPAIKLCHQIERVKVAFYAQYAN

SEQ ID NO: 76651 - protein, 160 aa, Homo sapiens
  Payload ID: 15304
  Gene Symbol: SFMBT2
  Gene Name: Scm-like with four mbt domains 2
  ENSP ID: ENSP00000369033
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDVESDVKPSASVQHIS

SEQ ID NO: 76652 - protein, 186 aa, Homo sapiens
  Payload ID: 15304
  Gene Symbol: SFMBT2
  Gene Name: Scm-like with four mbt domains 2
  ENSP ID: ENSP00000369035
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDAIKEKYTDWTEFLIRDLTGSRTAPANLLEGVCIVVIHLMYL

SEQ ID NO: 76653 - protein, 894 aa, Homo sapiens; identical to SEQ ID NO: 76650
  Payload ID: 15304
  Gene Symbol: SFMBT2
  Gene Name: Scm-like with four mbt domains 2
  Uniprot ID: Q5VUG0
  ENSP ID: ENSP00000380353

SEQ ID NO: 76654 - protein, 301 aa, Homo sapiens
  Payload ID: 15305
  Gene Symbol: SCO1
  Gene Name: SCO1 cytochrome c oxidase assembly protein
  Uniprot ID: O75880
  ENSP ID: ENSP00000255390
MAMLVLVPGRVMRPLGGQLWRFLPRGLEFWGPAEGTARVLLRQFCARQAEAWRASGRPGYCLGTRPLSTARPPPPWSQKGPGDSTRPSKPGPVSWKSLAITFAIGGALLAGMKHVKKEKAEKLEKERQRHIGKPLLGGPFSLTTHTGERKTDKDYLGQWLLIYFGFTHCPDVCPEELEKMIQVVDEIDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 76655 - protein, 270 aa, Homo sapiens
  Payload ID: 15305
  Gene Symbol: SCO1
  Gene Name: SCO1 cytochrome c oxidase assembly protein
  ENSP ID: ENSP00000463387
MAMLVLVPGRVMRPLGGQLWRFLPRGLEFWGPAEGTARVLLRQFCARQAEAWRASGRPGYCLGTRPLSTARPPPPWSQKGPGDSTRPSKPGPVSWKSLAITFAIGGALLAGMKHVKKEKAEKLEKERQRHIGKPLLGGPFSLTTHTGERKTDKDYLDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 76656 - protein, 91 aa, Homo sapiens
  Payload ID: 15305
  Gene Symbol: SCO1
  Gene Name: SCO1 cytochrome c oxidase assembly protein
  ENSP ID: ENSP00000464032
MAMLVLVPGRVMRPLGGQLWRFLPRGLEFWGPAEGTARVLLRQFCARQAEAWRASGRPGYCLGTRPLSTARPPPPWSQKGPGDSTRPSKPG

SEQ ID NO: 76657 - protein, 266 aa, Homo sapiens
  Payload ID: 15306
  Gene Symbol: SCO2
  Gene Name: SCO2 cytochrome c oxidase assembly protein
  Uniprot ID: O43819
  ENSP ID: ENSP00000252785
MLLLTRSPTAWHRLSQLKPRVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDICPDELEKLVQVVRQLEAEPGLPPVQPVFITVDPERDDVEAMARYVQDFHPRLLGLTGSTKQVAQASHSYRVYYNAGPKDEDQDYIVDHSIAIYLLNPDGLFTDYYGRSRSAEQISDSVRRHMAAFRSVLS

SEQ ID NO: 76658 - protein, 266 aa, Homo sapiens; identical to SEQ ID NO: 76657
  Payload ID: 15306
  Gene Symbol: SCO2
  Gene Name: SCO2 cytochrome c oxidase assembly protein
  Uniprot ID: O43819
  ENSP ID: ENSP00000379046

SEQ ID NO: 76659 - protein, 136 aa, Homo sapiens
  Payload ID: 15306
  Gene Symbol: SCO2
  Gene Name: SCO2 cytochrome c oxidase assembly protein
  ENSP ID: ENSP00000403570
MLLLTRSPTAWHRLSQLKPRVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDI

SEQ ID NO: 76660 - protein, 136 aa, Homo sapiens; identical to SEQ ID NO: 76659
  Payload ID: 15306
  Gene Symbol: SCO2
  Gene Name: SCO2 cytochrome c oxidase assembly protein
  ENSP ID: ENSP00000415642

SEQ ID NO: 76661 - protein, 266 aa, Homo sapiens; identical to SEQ ID NO: 76657
  Payload ID: 15306
  Gene Symbol: SCO2
  Gene Name: SCO2 cytochrome c oxidase assembly protein
  Uniprot ID: O43819
  ENSP ID: ENSP00000444242

SEQ ID NO: 76662 - protein, 266 aa, Homo sapiens; identical to SEQ ID NO: 76657
  Payload ID: 15306
  Gene Symbol: SCO2
  Gene Name: SCO2 cytochrome c oxidase assembly protein
  Uniprot ID: O43819
  ENSP ID: ENSP00000444433

SEQ ID NO: 76663 - protein, 5150 aa, Homo sapiens
  Payload ID: 15307
  Gene Symbol: SSPO
  Gene Name: SCO-spondin
  ENSP ID: ENSP00000485256
MLLPALLFGMAWALADGRWCEWTETIRVEEEVAPRQEDLVPCASLDHYSRLGWRLDLPWSGRSGLTRSPAPGLCPIYKPPETRPAKWNRTVRTCCPGWGGAHCTEALAKASPEGHCFAMWQCQLQAGSANASAGSLEECCARPWGQSWWDGSSQACRSCSSRHLPGSASSPALLQPLAGAVGQLWSQHQRPSATCASWSGFHYRTFDGRHYHFLGRCTYLLAGAADSTWAVHLTPGDRCPQPGHCQRVTMGPEEVLIQAGNVSVKGQLVPEGQSWLLHGLSLQWLGDWLVLSGGLGVVVRLDRTGSISISVDHELWGQTQGLCGLYNGWPEDDFMEPGGGLAMLAATFGNSWRLPGSESGCLDAVEVAQGCDSPLGLIDADVEPGHLRAEAQDVCHQLLEGPFGQCHAQVSPAEYHEACLFAYCAGAMAGSGQEGRQQAVCATFASYVQACARRHIHIRWRKPGFCERLCPGGQLYSDCVSLCPPSCEAVGQGEEESCREECVSGCECPRGLFWNGTLCVPAAHCPCYYCRQRYVPGDTVRQLCNPCVCRDGRWHCAQALCPAECAVGGDGHYLTFDGRSYSFWGGQGCRYSLVQDYVKGQLLILLEHGACDAGSCLHAISVSLEDTHIQLRDSGAVLVNGQDVGLPWIGAEGLSVRRASSAFLLLRWPGAQVLWGLSDPVAYITLDPRHAHQVQGLCGTFTQNQQDDFLTPAGDVETSIAAFASKFQVAGKGRCPSEDSALLSPCTTHSQRHAFAEAACAILHSSVFQECHRLVDKEPFYLRCLAAVCGCDPGSDCLCPVLSAYARRCAQEGASPPWRNQTLCPVMCPGGQEYRECAPACGQHCGKPEDCGELGSCVAGCNCPLGLLWDPEGQCVPPSLCPCQLGARRYAPGSATMKECNRCICQERGLWNCTARHCPSQAFCPRELVYAPGACLLTCDSPSANHSCPAGSTDGCVCPPGTVLLDERCVPPDLCPCRHSGQWYLPNATIQEDCNVCVCRGRQWHCTGQRRSGRCQASGAPHYVTFDGLAFTYPGACEYLLVREASGLFTVSAQNLPCGASGLTCTKALAVRLEGTVVHMLRGRAVTVNGVSVTPPKVYTGPGLSLRRAGLFLLLSTHLGLTLLWDGGTRVLVQLSPQFRGRVAGLCGDFDGDASNDLRSRQGVLEPTAELAAHSWRLSPLCPEPGDLPHPCTMNTHRAGWARARCGALLQPLFTLCHAEVPPQQHYEWCLYDACGCDSGGDCECLCSAIATYADECARHGHHVRWRSQELCSLQCEGGQVYEACGPTCPPTCHEQHPEPGWHCQVVACVEGCFCPEGTLLHGGACLEPASCPCEWGRNSFPPGSVLQKDCGNCTCQEGQWHCGGDGGHCEELVPACAEGEALCQENGHCVPHGWLCDNQDDCGDGSDEEGCAAPGCGEGQMTCSSGHCLPLALLCDRQDDCGDGTDEPSYPCPQGLLACADGRCLPPALLCDGHPDCLDAADEESCLGQVTCVPGEVSCVDGTCLGAIQLCDGVWDCPDGADEGPGHCPLPSLPTPPASTLPGPSPGSLDTASSPLASASPAPPCGPFEFRCGSGECTPRGWRCDQEEDCADGSDERGCGGPCAPHHAPCARGPHCVSPEQLCDGVRQCPDGSDEGPDACGGLPALGGPNRTGLPCPEYTCPNGTCIGFQLVCDGQPDCGRPGQVGPSPEEQGCGAWGPWSPWGPCSRTCGPWGQGRSRRCSPLGLLVLQNCPGPEHQSQACFTAACPVDGEWSTWSPWSVCSEPCRGTMTRQRQCHSPQNGGRTCAALPGGLHSTRQTKPCPQDGCPNATCSGELMFQPCAPCPLTCDDISGQVTCPPDWPCGSPGCWCPEGQVLGSEGWCVWPRQCPCLVDGARYWPGQRIKADCQLCICQDGRPRRCRLNPDCAVDCGWSSWSPWAKCLGPCGSQSIQWSFRSSNNPRPSGRGRQCRGIHRKARRCQTEPCEGCEHQGQVHRVGERWHGGPCRVCQCLHNLTAHCSPYCPLGSCPQGWVLVEGTGESCCHCALPGENQTVQPMATPAAAPAPSPQIRFPLATYILPPSGDPCYSPLGLAGLAEGSLHASSQQLEHPTQAALLGAPTQGPSPQGWHAGGDAYAKWHTRPHYLQLDLLQPRNLTGILVPETGSSNAYASSFSLQFSSNGLHWHDYRDLLPGILPLPKLFPRNWDDLDPAVWTFGRMVQARFVRVWPHDVHHSDVPLQVELLGCEPGSPPAPLCPGVGLRCASGECVLRGGPCDGVLDCEDGSDEEGCVLLPEGTGRFHSTAKTLALSSAQPGQLLHWPREGLAETEHWPPGQESPTSPTETRPVSPGPASGVPHHGESVQMVTTTPIPQMEARTLPPGMAAVTVVPPHPVTPATPAGQSVAPGPFPPVQCGPGQTPCEVLGCVEQAQVCDGREDCLDGSDERHCARNLLMWLPSLPALWAASTVPFMMPTMALPGLPASRALCSPSQLSCGSGECLSAERRCDLRPDCQDGSDEDGCVDCVLAPWSVWSSCSRSCGLGLTFQRQELLRPPLPGGSCPRDRFRSQSCFVQACPVAGAWAMWEAWGPCSVSCGGGHQSRQRSCVDPPPKNGGAPCPGASQERAPCGLQPCSGGTDCELGRVYVSADLCQKGLVPPCPPSCLDPKANRSCSGHCVEGCRCPPGLLLHDTRCLPLSECPCLVGEELKWPGVSFLLGNCSQCVCEKGELLCQPGGCPLPCGWSAWSSWAPCDRSCGSGVRARFRSPSNPPAAWGGAPCEGDRQELQGCHTVCGTEVFGWTPWTSWSSCSQSCLAPGGGPGWRSRSRLCPSPGDSSCPGDATQEEPCSPPVCPVPSIWGLWAPWSTCSAPCDGGIQTRGRSCSSLAPGDTTCPGPHSQTRDCNTQPCTAQCPENMLFRSAEQCHQEGGPCPRLCLTQGPGIECTGFCAPGCTCPPGLFLHNASCLPRSQCPCQLHGQLYASGAMARLDSCNNCTCVSGKMACTSERCPVACGWSPWTLWSLCSCSCNVGIRRRFRAGTAPPAAFGGAECQGPTMEAEFCSLRPCPGPGGEWGPWSPCSVPCGGGYRNRTRGSSRSLMEFSTCGLQPCAGPVPGMCPRDKQWLDCAQGPASCAELSAPRGTNQTCHPGCHCPSGMLLLNNVCVPTQDCPCAHEGHLYPPGSTVVRPCENCSCVSGLIANCSSWPCAEGEPTWSPWTPWSQCSASCGPARCHRHRFCARSPSAVPSTVAPLPLPATPTPLCSGPEAEEEPCLLQGCDRAGGWGPWGPWSHCSRSCGGGLRSRTRACDQPPPQGLGDYCEGPRAQGEVCQALPCPVTNCTAIEGAEYSPCGPPCPRSCDDLVHCVWRCQPGCYCPPGQVLSSNGAICVQPGHCSCLDLLTGQRHHPGARLARPDGCNHCTCLEGRLNCTDLPCPVPGGWCPWSEWTMCSQPCRGQTRSRSRACACPTPQHGGAPCTGEAGEAGAQHQREACPSYATCPVDGAWGPWGPWSPCDMCLGQSHRSRACSRPPTPEGGRPCPGNHTQSRPCQENSTQCTDCGGGQSLHPCGQPCPRSCQDLSPGSVCQPGSVGCQPTCGCPLGQLSQDGLCVPPAHCRCQYQPGAMGIPENQSRSAGSRFSSWESLEPGEVVTGPCDNCTCVAGILQCQEVPDCPDPGVWSSWGPWEDCSVSCGGGEQLRSRRCARPPCPGPARQSRTCSTQVCREAGCPAGRLYRECQPGEGCPFSCAHVTQQVGCFSEGCEEGCHCPEGTFQHRLACVQECPCVLTAWLLQELGATIGDPGQPLGPGDELDSGQTLRTSCGNCSCAHGKLSCSLDDCFEADGGFGPWSPWGPCSRSCGGLGTRTRSRQCVLTMPTLSGQGCRGPRQDLEYCPSPDCPGAEGSTVEPVTGLPGGWGPWSSWSPCSRSCTDPARPAWRSRTRLCLANCTMGDPLQERPCNLPSCTELPVCPGPGCGAGNCSWTSWAPWEPCSRSCGVGQQRRLRAYRPPGPGGHWCPNILTAYQERRFCNLRACPVPGGWSRWSPWSWCDRSCGGGQSLRSRSCSSPPSKNGGAPCAGERHQARLCNPMPCEAGCPAGMEVVTCANRCPRRCSDLQEGIVCQDDQVCQKGCRCPKGSLEQDGGCVPIGHCDCTDAQGHSWAPGSQHQDACNNCSCQAGQLSCTAQPCPPPTHCAWSHWSAWSPCSHSCGPRGQQSRFRSSTSGSWAPECREEQSQSQPCPQPSCPPLCLQGTRSRTLGDSWLQGECQRCSCTPEGVICEDTECAVPEAWTLWSSWSDCPVSCGGGNQVRTRACRAAAPHHRSPPCLGPDTQTRQQPCPGLLEACSWGPWGPCSRSCGPGLASRSGSCPCLMAKADPTCNSTFLHLDTQGCYSGPCPEECVWSSWSSWTRCSCRVLVQQRYRHQGPASRGARAGAPCTRLDGHFRPCLISNCSEDSCTPPFEFHACGSPCAGLCATHLSHQLCQDLPPCQPGCYCPKGLLEQAGGCIPPEECNCWHTSAAGAGMTLAPGDRLQLGCKECECRRGELHCTSQGCQGLLPLSEWSEWSPCGPCLPPSALAPASRTALEEHWLRDPTGLSPTLAPLLASEQHRHRLCLDPATGRPWTGAPHLCTAPLSQQRLCPDPGACPDSCQWSLWGPWSPCQVPCSGGFRLRWREAEALCGGGCREPWAQESCNGGPCPESCEAQDTVFTLDCANQCPHSCADLWDRVQCLQGPCRPGCRCPPGQLVQDGRCVPISSCRCGLPSANASWELAPAQAVQLDCQNCTCVNESLVCPHQECPVLGPWSAWSSCSAPCGGGTMERHRTCEGGPGVAPCQAQDTEQRQECNLQPCPECPPGQVLSACATSCPCLCWHLQPGAICVQEPCQPGCGCPGGQLLHNGTCVPPTACPCTQHSLPWGLTLTLEEQAQELPPGTVLTRNCTRCVCHGGAFSCSLVDCQVPPGETWQQVAPGELGLCEQTCLEMNATKTQSNCSSARASGCVCQPGHFRSQAGPCVPEDHCECWHLGRPHLPGSEWQEACESCLCLSGRPVCTQHCSPLTCAQGEEMVLEPGSCCPSCRREAPEEQSPSCQLLTELRNFTKGTCYLDQVEVSYCSGYCPSSTHVMPEEPYLQSQCDCCSYRLDPESPVRILNLRCLGGHTEPVVLPVIHSCQCSSCQGGDFSKR

SEQ ID NO: 76664 - protein, 156 aa, Homo sapiens
  Payload ID: 15308
  Gene Symbol: SCP2D1
  Gene Name: SCP2 sterol-binding domain containing 1
  Uniprot ID: Q9UJQ7
  ENSP ID: ENSP00000366645
MWKRSDHQPKIKAEDGPLVGQFEVLGSVPEPAMPHPLELSEFESFPVFQDIRLHIREVGAQLVKKVNAVFQLDITKNGKTILRWTIDLKNGSGDMYPGPARLPADTVFTIPESVFMELVLGKMNPQKAFLAGKFKVSGKVLLSWKLERVFKDWAKF

SEQ ID NO: 76665 - protein, 348 aa, Homo sapiens
  Payload ID: 15309
  Gene Symbol: SCRT1
  Gene Name: scratch family zinc finger 1
  Uniprot ID: Q9BWW7
  ENSP ID: ENSP00000455711
MPRSFLVKKVKLDAFSSADLESAYGRARSDLGAPLHDKGYLSDYVGPSSVYDGDAEAALLKGPSPEPMYAAAVRGELGPAAAGSAPPPTPRPELATAAGGYINGDAAVSEGYAADAFFITDGRSRRKASNAGAAAAPSTASAAAPDGDAGGGGGAGGRSLGSGPGGRGGTRAGAGTEARAGPGAAGAGGRHACGECGKTYATSSNLSRHKQTHRSLDSQLARRCPTCGKVYVSMPAMAMHLLTHDLRHKCGVCGKAFSRPWLLQGHMRSHTGEKPFGCAHCGKAFADRSNLRAHMQTHSAFKHFQCKRCKKSFALKSYLNKHYESACFKGGAGGPAAPAPPQLSPVQA

SEQ ID NO: 76666 - protein, 307 aa, Homo sapiens
  Payload ID: 15310
  Gene Symbol: SCRT2
  Gene Name: scratch family zinc finger 2
  Uniprot ID: Q9NQ03
  ENSP ID: ENSP00000246104
MPRSFLVKKIKGDGFQCSGVPAPTYHPLETAYVLPGARGPPGDNGYAPHRLPPSSYDADQKPGLELAPAEPAYPPAAPEEYSDPESPQSSLSARYFRGEAAVTDSYSMDAFFISDGRSRRRRGGGGGDAGGSGDAGGAGGRAGRAGAQAGGGHRHACAECGKTYATSSNLSRHKQTHRSLDSQLARKCPTCGKAYVSMPALAMHLLTHNLRHKCGVCGKAFSRPWLLQGHMRSHTGEKPFGCAHCGKAFADRSNLRAHMQTHSAFKHYRCRQCDKSFALKSYLHKHCEAACAKAAEPPPPTPAGPAS

SEQ ID NO: 76667 - protein, 1630 aa, Homo sapiens
  Payload ID: 15311
  Gene Symbol: SCRIB
  Gene Name: scribbled planar cell polarity protein
  Uniprot ID: Q14160
  ENSP ID: ENSP00000322938
MLKCIPLWRCNRHVESVDKRHCSLQAVPEEIYRYSRSLEELLLDANQLRELPKPFFRLLNLRKLGLSDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPPSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 76668 - protein, 1655 aa, Homo sapiens
  Payload ID: 15311
  Gene Symbol: SCRIB
  Gene Name: scribbled planar cell polarity protein
  Uniprot ID: Q14160
  ENSP ID: ENSP00000349486
MLKCIPLWRCNRHVESVDKRHCSLQAVPEEIYRYSRSLEELLLDANQLRELPKPFFRLLNLRKLGLSDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPPSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLPLSGKKFDYRAFAALPSSRPVYDIQSPDFAEELRSLEPSPSPGPQEEDGEVALVLLGRPSPGAVGPEDVALCSSRRPVRPGRRGLGPVPS

SEQ ID NO: 76669 - protein, 1549 aa, Homo sapiens
  Payload ID: 15311
  Gene Symbol: SCRIB
  Gene Name: scribbled planar cell polarity protein
  Uniprot ID: Q14160
  ENSP ID: ENSP00000366756
MQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPPSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 76670 - protein, 650 aa, Homo sapiens
  Payload ID: 15311
  Gene Symbol: SCRIB
  Gene Name: scribbled planar cell polarity protein
  ENSP ID: ENSP00000431519
  MOD_RES (1)..(1): Any amino acid
XRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEGEGHGSGVGVGSRLVWPDPPCPPAARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 76671 - protein, 140 aa, Homo sapiens
  Payload ID: 15311
  Gene Symbol: SCRIB
  Gene Name: scribbled planar cell polarity protein
  ENSP ID: ENSP00000433546
EEEEASTEEEDKEGAVVSAPSVKLTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGG

SEQ ID NO: 76672 - protein, 1549 aa, Homo sapiens; identical to SEQ ID NO: 76669
  Payload ID: 15311
  Gene Symbol: SCRIB
  Gene Name: scribbled planar cell polarity protein
  ENSP ID: ENSP00000479898

SEQ ID NO: 76673 - protein, 1630 aa, Homo sapiens; identical to SEQ ID NO: 76667
  Payload ID: 15311
  Gene Symbol: SCRIB
  Gene Name: scribbled planar cell polarity protein
  ENSP ID: ENSP00000482406

SEQ ID NO: 76674 - protein, 1655 aa, Homo sapiens; identical to SEQ ID NO: 76668
  Payload ID: 15311
  Gene Symbol: SCRIB
  Gene Name: scribbled planar cell polarity protein
  ENSP ID: ENSP00000484041

SEQ ID NO: 76675 - protein, 650 aa, Homo sapiens; identical to SEQ ID NO: 76670
  Payload ID: 15311
  Gene Symbol: SCRIB
  Gene Name: scribbled planar cell polarity protein
  ENSP ID: ENSP00000487699
  MOD_RES (1)..(1): Any amino acid

SEQ ID NO: 76676 - protein, 140 aa, Homo sapiens; identical to SEQ ID NO: 76671
  Payload ID: 15311
  Gene Symbol: SCRIB
  Gene Name: scribbled planar cell polarity protein
  ENSP ID: ENSP00000487972

SEQ ID NO: 76677 - protein, 808 aa, Homo sapiens
  Payload ID: 15312
  Gene Symbol: SCYL1
  Gene Name: SCY1-like, kinase-like 1
  Uniprot ID: Q96KG9
  ENSP ID: ENSP00000270176
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 76678 - protein, 270 aa, Homo sapiens [sequence omitted]

SEQ ID NO: 76679 - protein, 791 aa, Homo sapiens
  Payload ID: 15312
  Gene Symbol: SCYL1
  Gene Name: SCY1-like, kinase-like 1
  Uniprot ID: Q96KG9
  ENSP ID: ENSP00000408192
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 76680 - protein, 780 aa, Homo sapiens
  Payload ID: 15312
  Gene Symbol: SCYL1
  Gene Name: SCY1-like, kinase-like 1
  ENSP ID: ENSP00000431635
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEEAESVLAQQDDWSTGGQVSRASQVSNSDHKSSKSPESDWSSWEAEGSWEQGWQEPSSQEPPPDGTRLASEYNWGGPESSDKGDPFATLSARPSTQDRSRLSWPGRSARSGGGRWRPNAPRGRWPRAP

SEQ ID NO: 76681 - protein, 175 aa, Homo sapiens
  Payload ID: 15312
  Gene Symbol: SCYL1
  Gene Name: SCY1-like, kinase-like 1
  ENSP ID: ENSP00000431664
  MOD_RES (1)..(1): Any amino acid
XHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVGCPCSLQPWHGRSRS

SEQ ID NO: 76682 - protein, 775 aa, Homo sapiens
  Payload ID: 15312
  Gene Symbol: SCYL1
  Gene Name: SCY1-like, kinase-like 1
  ENSP ID: ENSP00000432175
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRKCFPWVG

SEQ ID NO: 76683 - protein, 280 aa, Homo sapiens
  Payload ID: 15312
  Gene Symbol: SCYL1
  Gene Name: SCY1-like, kinase-like 1
  ENSP ID: ENSP00000433604
KAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 76684 - protein, 665 aa, Homo sapiens
  Payload ID: 15312
  Gene Symbol: SCYL1
  Gene Name: SCY1-like, kinase-like 1
  ENSP ID: ENSP00000436993
MAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 76685 - protein, 787 aa, Homo sapiens
  Payload ID: 15312
  Gene Symbol: SCYL1
  Gene Name: SCY1-like, kinase-like 1
  Uniprot ID: Q96KG9
  ENSP ID: ENSP00000437254
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQSPTGAAGKLRAPGNRAGRSQAPRSHLLTVHGWPASITGVAQSPATRATPSLPCLHVPAPSRGQTLGVRTTGRASRLTVDRSRLSWPGRSARSGGGRWRPNAPRGRWPRAP

SEQ ID NO: 76686 - protein, 929 aa, Homo sapiens
  Payload ID: 15313
  Gene Symbol: SCYL2
  Gene Name: SCY1-like, kinase-like 2
  Uniprot ID: Q6P3W7
  ENSP ID: ENSP00000354061
MESMLNKLKSTVTKVTADVTSAVMGNPVTREFDVGRHIASGGNGLAWKIFNGTKKSTKQEVAVFVFDKKLIDKYQKFEKDQIIDSLKRGVQQLTRLRHPRLLTVQHPLEESRDCLAFCTEPVFASLANVLGNWENLPSPISPDIKDYKLYDVETKYGLLQVSEGLSFLHSSVKMVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACLQTSSLAVRVNSLVCLGKILEYLDKWFVLDDILPFLQQIPSKEPAVLMGILGIYKCTFTHKKLGITKEQLAGKVLPHLIPLSIENNLNLNQFNSFISVIKEMLNRLESEHKTKLEQLHIMQEQQKSLDIGNQMNVSEEMKVTNIGNQQIDKVFNNIGADLLTGSESENKEDGLQNKHKRASLTLEEKQKLAKEQEQAQKLKSQQPLKPQVHTPVATVKQTKDLTDTLMDNMSSLTSLSVSTPKSSASSTFTSVPSMGIGMMFSTPTDNTKRNLTNGLNANMGFQTSGFNMPVNTNQNFYSSPSTVGVTKMTLGTPPTLPNFNALSVPPAGAKQTQQRPTDMSALNNLFGPQKPKVSMNQLSQQKPNQWLNQFVPPQGSPTMGSSVMGTQMNVIGQSAFGMQGNPFFNPQNFAQPPTTMTNSSSASNDLKDLFG

SEQ ID NO: 76687 - protein, 681 aa, Homo sapiens
  Payload ID: 15313
  Gene Symbol: SCYL2
  Gene Name: SCY1-like, kinase-like 2
  ENSP ID: ENSP00000448366
MESMLNKLKSTVTKVTADVTSAVMGNPVTREFDVGRHIASGGNGLAWKIFNGTKKSTKQEVAVFVFDKKLIDKYQKFEKDQIIDSLKRGVQQLTRLRHPRLLTVQHPLEESRDCLAFCTEPVFASLANVLGNWENLPSPISPDIKDYKLYDVETKYGLLQVSEGLSFLHSSVKMVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACLQTSSLAVRVNSLVCLGKILEYLDKWFVLDDILPFLQQIPSKEPAVLMGILGIYKCTFTHKKLGITKEQLAGKVLPHLIPLSIENNLNLNQFNSFISVIKEMLNRLESEHKTKLEQLHIMQEQQKSLDIGNQMNVSEEMKVTNIGNQQIDKVFNNIGADLLTGSESENKEDGLQNKHKRASLTLE

SEQ ID NO: 76688 - protein, 60 aa, Homo sapiens
  Payload ID: 15313
  Gene Symbol: SCYL2
  Gene Name: SCY1-like, kinase-like 2
  ENSP ID: ENSP00000448400
  MOD_RES (1)..(1): Any amino acid
XRIKNACLQTSSLAVRVNSLVCLGKILEYLDKWFVLDDILPFLQQIPSKEPAVLMGILGN

SEQ ID NO: 76689 - protein, 114 aa, Homo sapiens
  Payload ID: 15313
  Gene Symbol: SCYL2
  Gene Name: SCY1-like, kinase-like 2
  ENSP ID: ENSP00000449567
RVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQICLLKGEGMLPLSK

SEQ ID NO: 76690 - protein, 76 aa, Homo sapiens
  Payload ID: 15313
  Gene Symbol: SCYL2
  Gene Name: SCY1-like, kinase-like 2
  ENSP ID: ENSP00000450294
MVHGNITPENIILNKSGAWKIMGFDFCVSSTNPSEQEPKFPCKEWDPNLPSLCLPNPEYLAPEYILSVSCETASDM

SEQ ID NO: 76691 - protein, 933 aa, Homo sapiens
  Payload ID: 15313
  Gene Symbol: SCYL2
  Gene Name: SCY1-like, kinase-like 2
  ENSP ID: ENSP00000489123
MESMLNKLKSTVTKVTADVTSAVMGNPVTREFDVGRHIASGGNGLAWKIFNGTKKSTKQEVAVFVFDKKLIDKYQKFEKDQIIDSLKRGVQQLTRLRHPRLLTVQHPLEESRDCLAFCTEPVFASLANVLGNWENLPSPISPDIKDYKLYDVETKYGLLQVSEGLSFLHSSVKMVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQASNMILLIFLQKMDLLLTKTPPDEIKNSVLPMVYRALEAPSIQIQELCLNIIPTFANLIDYPSMKNALIPRIKNACLQTSSLAVRVNSLVCLGKILEYLDKWFVLDDILPFLQQIPSKEPAVLMGILGIYKCTFTHKKLGITKEQLAGKVLPHLIPLSIENNLNLNQFNSFISVIKEMLNRLESEHKTKLEQLHIMQEQQKSLDIGNQMNVSEEMKVTNIGNQQIDKVFNNIGADLLTGSESENKEDGLQNKHKRASLTLEEKQKLAKEQEQAQKLKSQQPLKPQVHTPVATVKQTKDLTDTLMDNMSSLTSLSVSTPKSSASSTFTSVPSMGIGMMFSTPTDNTKRNLTNGLNANMGFQTSGFNMPVNTNQNFYSSPSTVGVTKMTLGTPPTLPNFNALSVPPAGAKQTQQRPTDMSALNNLFGPQKPKVSMNQLSQQKPNQWLNQFVPPQGSPTMGSSVMGTQMNVIGQSAFGMQGNPFFNPQNFAQPPTTMTNSSSASNDLKDLFG

SEQ ID NO: 76692 - protein, 742 aa, Homo sapiens
  Payload ID: 15314
  Gene Symbol: SCYL3
  Gene Name: SCY1-like, kinase-like 3
  Uniprot ID: Q8IZE3
  ENSP ID: ENSP00000356744
MGSENSALKSYTLREPPFTLPSGLAVYPAVLQDGKFASVFVYKRENEDKVNKAAKHLKTLRHPCLLRFLSCTVEADGIHLVTERVQPLEVALETLSSAEVCAGIYDILLALIFLHDRGHLTHNNVCLSSVFVSEDGHWKLGGMETVCKVSQATPEFLRSIQSIRDPASIPPEEMSPEFTTLPECHGHARDAFSFGTLVESLLTILNEQVSADVLSSFQQTLHSTLLNPIPKCRPALCTLLSHDFFRNDFLEVVNFLKSLTLKSEEEKTEFFKFLLDRVSCLSEELIASRLVPLLLNQLVFAEPVAVKSFLPYLLGPKKDHAQGETPCLLSPALFQSRVIPVLLQLFEVHEEHVRMVLLSHIEAYVEHFTQEQLKKVILPQVLLGLRDTSDSIVAITLHSLAVLVSLLGPEVVVGGERTKIFKRTAPSFTKNTDLSLEDSPMCVVCSHHSQISPILENPFSSIFPKCFFSGSTPINSKKHIQRDYYNTLLQTGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSSQERPLKVPSELGLGEEFTIQVKKKPVKDPEMDWFADMIPEIKPSAAFLILPELRTEMVPKKDDVSPVMQFSSKFAAAEITEGEAEGWEEEGELNWEDNNW

SEQ ID NO: 76693 - protein, 688 aa, Homo sapiens
  Payload ID: 15314
  Gene Symbol: SCYL3
  Gene Name: SCY1-like, kinase-like 3
  Uniprot ID: Q8IZE3
  ENSP ID: ENSP00000356745
MGSENSALKSYTLREPPFTLPSGLAVYPAVLQDGKFASVFVYKRENEDKVNKAAKHLKTLRHPCLLRFLSCTVEADGIHLVTERVQPLEVALETLSSAEVCAGIYDILLALIFLHDRGHLTHNNVCLSSVFVSEDGHWKLGGMETVCKVSQATPEFLRSIQSIRDPASIPPEEMSPEFTTLPECHGHARDAFSFGTLVESLLTILNEQVSADVLSSFQQTLHSTLLNPIPKCRPALCTLLSHDFFRNDFLEVVNFLKSLTLKSEEEKTEFFKFLLDRVSCLSEELIASRLVPLLLNQLVFAEPVAVKSFLPYLLGPKKDHAQGETPCLLSPALFQSRVIPVLLQLFEVHEEHVRMVLLSHIEAYVEHFTQEQLKKVILPQVLLGLRDTSDSIVAITLHSLAVLVSLLGPEVVVGGERTKIFKRTAPSFTKNTDLSLEGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSSQERPLKVPSELGLGEEFTIQVKKKPVKDPEMDWFADMIPEIKPSAAFLILPELRTEMVPKKDDVSPVMQFSSKFAAAEITEGEAEGWEEEGELNWEDNNW

SEQ ID NO: 76694 - protein, 742 aa, Homo sapiens; identical to SEQ ID NO: 76692
  Payload ID: 15314
  Gene Symbol: SCYL3
  Gene Name: SCY1-like, kinase-like 3
  Uniprot ID: Q8IZE3
  ENSP ID: ENSP00000356746

SEQ ID NO: 76695 - protein, 588 aa, Homo sapiens
  Payload ID: 15314
  Gene Symbol: SCYL3
  Gene Name: SCY1-like, kinase-like 3
  ENSP ID: ENSP00000407993
MGSENSALKSYTLREPPFTLPSGLAVYPAVLQDGKFASVFVYKRENEDKVNKAAKHLKTLRHPCLLRFLSCTVEADGIHLVTERVQPLEVALETLSSAEVCAGIYDILLALIFLHDRGHLTHNNVCLSSVFVSEDGHWKLGGMETVCKVSQATPEFLRSIQSIRDPASIPPEEMSPEFTTLPECHGHARDAFSFGTLVESLLTILNEQVSADVLSSFQQTLHSTLLNPIPKCRPALCTLLSHDFFRNDFLEVVNFLKSLTLKSEEEKTEFFKFLLDRVSCLSEELIASRLVPLLLNQLVFAEPVAVKSFLPYLLGPKKDHAQGETPCLLSPALFQSRVIPVLLQLFEVHEEHVRMVLLSHIEAYVEHFTQEQLKKVILPQVLLGLRDTSDSIVAITLHSLAVLVSLLGPEVVVGGERTKIFKRTAPSFTKNTDLSLEGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSS

SEQ ID NO: 76696 - protein, 687 aa, Homo sapiens
  Payload ID: 15315
  Gene Symbol: SDAD1
  Gene Name: SDA1 domain containing 1
  Uniprot ID: Q9NVU7
  ENSP ID: ENSP00000348596
MSNRNNNKLPSNLPQLQNLIKRDPPAYIEEFLQQYNHYKSNVEIFKLQPNKPSKELAELVMFMAQISHCYPEYLSNFPQEVKDLLSCNHTVLDPDLRMTFCKALILLRNKNLINPSSLLELFFELFRCHDKLLRKTLYTHIVTDIKNINAKHKNNKVNVVLQNFMYTMLRDSNATAAKMSLDVMIELYRRNIWNDAKTVNVITTACFSKVTKILVAALTFFLGKDEDEKQDSDSESEDDGPTARDLLVQYATGKKSSKNKKKLEKAMKVLKKQKKKKKPEVFNFSAIHLIHDPQDFAEKLLKQLECCKERFEVKMMLMNLISRLVGIHELFLFNFYPFLQRFLQPHQREVTKILLFAAQASHHLVPPEIIQSLLMTVANNFVTDKNSGEVMTVGINAIKEITARCPLAMTEELLQDLAQYKTHKDKNVMMSARTLIHLFRTLNPQMLQKKFRGKPTEASIEARVQEYGELDAKDYIPGAEVLEVEKEENAENDEDGWESTSLSEEEDADGEWIDVQHSSDEEQQEISKKLNSMPMEERKAKAAAISTSRVLTQEDFQKIRMAQMRKELDAAPGKSQKRKYIEIDSDEEPRGELLSLRDIERLHKKPKSDKETRLATAMAGKTDRKEFVRKKTKTNPFSSSTNKEKKKQKNFMMMRYSQNVRSKNKRSFREKQLALRDALLKKRKRMK

SEQ ID NO: 76697 - protein, 72 aa, Homo sapiens
  Payload ID: 15315
  Gene Symbol: SDAD1
  Gene Name: SDA1 domain containing 1
  ENSP ID: ENSP00000379060
MSNRNNNKLPSNLPQLQNLIKRDPPAYIEEFLQQYNHYKSNVEIFKLQPNKPSKELAELVMFMAQNILNVCI

SEQ ID NO: 76698 - protein, 650 aa, Homo sapiens
  Payload ID: 15315
  Gene Symbol: SDAD1
  Gene Name: SDA1 domain containing 1
  ENSP ID: ENSP00000379061
MSNRNNNKLPSNLPQLQNLIKRDPPAYIEEFLQQYNHYKSNVEIFKLQPNKPSKELAELVMFMAQISHCYPEYLSNFPQEVKDLLSCNHTVLDPDLRMTLYTHIVTDIKNINAKHKNNKVNVVLQNFMYTMLRDSNATAAKMSLDVMIELYRRNIWNDAKTVNVITTACFSKVTKILVAALTFFLGKDEDEKQDSDSESEDDGPTARDLLVQYATGKKSSKNKKKLEKAMKVLKKQKKKKKPEVFNFSAIHLIHDPQDFAEKLLKQLECCKERFEVKMMLMNLISRLVGIHELFLFNFYPFLQRFLQPHQREVTKILLFAAQASHHLVPPEIIQSLLMTVANNFVTDKNSGEVMTVGINAIKEITARCPLAMTEELLQDLAQYKTHKDKNVMMSARTLIHLFRTLNPQMLQKKFRGKPTEASIEARVQEYGELDAKDYIPGAEVLEVEKEENAENDEDGWESTSLSEEEDADGEWIDVQHSSDEEQQEISKKLNSMPMEERKAKAAAISTSRVLTQEDFQKIRMAQMRKELDAAPGKSQKRKYIEIDSDEEPRGELLSLRDIERLHKKPKSDKETRLATAMAGKTDRKEFVRKKTKTNPFSSSTNKEKKKQKNFMMMRYSQNVRSKNKRSFREKQLALRDALLKKRKRMK

SEQ ID NO: 76699 - protein, 88 aa, Homo sapiens
  Payload ID: 15315
  Gene Symbol: SDAD1
  Gene Name: SDA1 domain containing 1
  ENSP ID: ENSP00000422368
MSNRNNNKLPSNLPQLQNLIKRDPPAYIEEFLQQYNHYKSNVEIFKLQPNKPSKELAELVMFMAQERKRATSEEPLLCYRLVTATQST

SEQ ID NO: 76700 - protein, 47 aa, Homo sapiens
  Payload ID: 15315
  Gene Symbol: SDAD1
  Gene Name: SDA1 domain containing 1
  ENSP ID: ENSP00000427443
MVETPFLQQYNHYKSNVEIFKLQPNKPSKELAELVMFMAQNILNVCI

SEQ ID NO: 76701 - protein, 451 aa, Homo sapiens
  Payload ID: 15316
  Gene Symbol: SDE2
  Gene Name: SDE2 telomere maintenance homolog (S. pombe)
  Uniprot ID: Q6IQ49
  ENSP ID: ENSP00000272091
MAEAAALVWIRGPGFGCKAVRCASGRCTVRDFIHRHCQDQNVPVENFFVKCNGALINTSDTVQHGAVYSLEPRLCGGKGGFGSMLRALGAQIEKTTNREACRDLSGRRLRDVNHEKAMAEWVKQQAEREAEKEQKRLERLQRKLVEPKHCFTSPDYQQQCHEMAERLEDSVLKGMQAASSKMVSAEISENRKRQWPTKSQTDRGASAGKRRCFWLGMEGLETAEGSNSESSDDDSEEAPSTSGMGFHAPKIGSNGVEMAAKFPSGSQRARVVNTDHGSPEQLQIPVTDSGRHILEDSCAELGESKEHMESRMVTETEETQEKKAESKEPIEEEPTGAGLNKDKETEERTDGERVAEVAPEERENVAVAKLQESQPGNAVIDKETIDLLAFTSVAELELLGLEKLKCELMALGLKCGGTLQERAARLFSVRGLAKEQIDPALFAKPLKGKKK

SEQ ID NO: 76702 - protein, 328 aa, Homo sapiens
  Payload ID: 15317
  Gene Symbol: SUDS3
  Gene Name: SDS3 homolog, SIN3A corepressor complex component
  Uniprot ID: Q9H7L9
  ENSP ID: ENSP00000443988
MSAAGLLAPAPAQAGAPPAPEYYPEEDEELESAEDDERSCRGRESDEDTEDASETDLAKHDEEDYVEMKEQMYQDKLASLKRQLQQLQEGTLQEYQKRMKKLDQQYKERIRNAELFLQLETEQVERNYIKEKKAAVKEFEDKKVELKENLIAELEEKKKMIENEKLTMELTGDSMEVKPIMTRKLRRRPNDPVPIPDKRRKPAPAQLNYLLTDEQIMEDLRTLNKLKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 76703 - protein, 216 aa, Homo sapiens
  Payload ID: 15318
  Gene Symbol: SEBOX
  Gene Name: SEBOX homeobox
  Uniprot ID: Q9HB31
  ENSP ID: ENSP00000395142
MGGSGVGTAWHGPLARPSGTLPFASSMPSPVDASSADGGSGLGSHRRKRTTFSKGQLLELERAFAAWPYPNISTHEHLAWVTCLPEAKVQVWFQKRWAKIIKNRKSGILSPGSECPQSSCSLPDTLQQPWDPQMPGQPPPSSGTPQRTSVCRHSSCPAPGLSPRQGWEGAKAVAPWGSAGASEVHPSLERATPQTSLGSLSDLIYALAIVVNVDHS

SEQ ID NO: 76704 - protein, 190 aa, Homo sapiens
  Payload ID: 15318
  Gene Symbol: SEBOX
  Gene Name: SEBOX homeobox
  ENSP ID: ENSP00000444503
MPSPVDASSADGGSGLGSHRRKRTTFSKGQLLELERAFAAWPYPNISTHEHLAWVTCLPEAKVQVWFQKRWAKIIKNRKSGILSPGSECPQSSCSLPDTLQQPWDPQMPGQPPPSSGTPQRTSVCRHSSCPAPGLSPRQGWEGAKAVAPWGSAGASEVHPSLERATPQTSLGSLSDLIYALAIVVNVDHS

SEQ ID NO: 76705 - protein, 163 aa, Homo sapiens
  Payload ID: 15319
  Gene Symbol: SCFD1
  Gene Name: sec1 family domain containing 1
  ENSP ID: ENSP00000309417
MAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKPLTGQISQTRKWKLLWTL

SEQ ID NO: 76706 - protein, 550 aa, Homo sapiens
  Payload ID: 15319
  Gene Symbol: SCFD1
  Gene Name: sec1 family domain containing 1
  Uniprot ID: Q8WVM8
  ENSP ID: ENSP00000379870
MPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 76707 - protein, 642 aa, Homo sapiens
  Payload ID: 15319
  Gene Symbol: SCFD1
  Gene Name: sec1 family domain containing 1
  Uniprot ID: Q8WVM8
  ENSP ID: ENSP00000390783
MAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 76708 - protein, 575 aa, Homo sapiens
  Payload ID: 15319
  Gene Symbol: SCFD1
  Gene Name: sec1 family domain containing 1
  Uniprot ID: Q8WVM8
  ENSP ID: ENSP00000443010
MGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 76709 - protein, 35 aa, Homo sapiens
  Payload ID: 15319
  Gene Symbol: SCFD1
  Gene Name: sec1 family domain containing 1
  ENSP ID: ENSP00000450546
AFTKMASAPASYGSTTTKPMGCDTHGSRNSQDPSV

SEQ ID NO: 76710 - protein, 198 aa, Homo sapiens
  Payload ID: 15319
  Gene Symbol: SCFD1
  Gene Name: sec1 family domain containing 1
  ENSP ID: ENSP00000450755
MLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAV

SEQ ID NO: 76711 - protein, 92 aa, Homo sapiens
  Payload ID: 15319
  Gene Symbol: SCFD1
  Gene Name: sec1 family domain containing 1
  ENSP ID: ENSP00000451064
MLNFNVPHIKNSTGEPVWKVLIYDRFGQDIISPLLSVKELRDMGITLHLLLHSDRDPIPDVPAVYFVMPTEENIDRMCQVESVTRVAAKVNI

SEQ ID NO: 76712 - protein, 48 aa, Homo sapiens
  Payload ID: 15319
  Gene Symbol: SCFD1
  Gene Name: sec1 family domain containing 1
  ENSP ID: ENSP00000451298
MAAAAAATAAAAASIRERQTVALKRMLNFNVPHIKNSTGEPVWKAFTL

SEQ ID NO: 76713 - protein, 75 aa, Homo sapiens
  Payload ID: 15319
  Gene Symbol: SCFD1
  Gene Name: sec1 family domain containing 1
  ENSP ID: ENSP00000451811
MAAAAAATAAAAASIRERQTVALKRMLNFNVPHIKNSTGEPVWKVLIYDRFGQDIISPLLSVKELRDMGITLHLH

SEQ ID NO: 76714 - protein, 102 aa, Homo sapiens
  Payload ID: 15319
  Gene Symbol: SCFD1
  Gene Name: sec1 family domain containing 1
  ENSP ID: ENSP00000452046
  MOD_RES (1)..(1): Any amino acid
XALKRMLNFNVPHIKNSTGEPVWKVLIYDRFGQDIISPLLSVKELRDMGITLHLLLHSDRDPIPDVPAVYFVMPTEENIDRMCQPLTGQISQTRKWKLLWTL

SEQ ID NO: 76715 - protein, 55 aa, Homo sapiens
  Payload ID: 15319
  Gene Symbol: SCFD1
  Gene Name: sec1 family domain containing 1
  ENSP ID: ENSP00000452178
MGITLHLLLHSDRDPIPDVPAVYFVMPTEENIDRMCQASNLCSHQQEEGHGLCQP

SEQ ID NO: 76716 - protein, 84 aa, Homo sapiens
  Payload ID: 15319
  Gene Symbol: SCFD1
  Gene Name: sec1 family domain containing 1
  ENSP ID: ENSP00000452308
MFVLCNQNKELVSYRAINRPDITDTEMETVMDTIVDSLFCFFVTLGAVPIIRCSRGTAAEMVAVKLDKKLRENLRDARNSLFTG

SEQ ID NO: 76717 - protein, 121 aa, Homo sapiens
  Payload ID: 15319
  Gene Symbol: SCFD1
  Gene Name: sec1 family domain containing 1
  ENSP ID: ENSP00000452323
MAAAAAATAAAAASIRERQTVALKRMLNFNVPHIKNSTGEPVWKVLIYDRFGQDIISPLLSVKELRDMGITLHLFLTNISILLLWKMICLYYVIKIRSLFHIVPLTGQISQTRKWKLLWTL

SEQ ID NO: 76718 - protein, 144 aa, Homo sapiens
  Payload ID: 15319
  Gene Symbol: SCFD1
  Gene Name: sec1 family domain containing 1
  ENSP ID: ENSP00000452448
VFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLERWI

SEQ ID NO: 76719 - protein, 639 aa, Homo sapiens
  Payload ID: 15320
  Gene Symbol: SCFD2
  Gene Name: sec1 family domain containing 2
  Uniprot ID: Q8WU76
  ENSP ID: ENSP00000373592
MSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQSIGESAMSVVLNQLLPMIKPVTQRTNEDYSPEELLILLIYIYSVTGELTVDKDLCEAEEKVKKALAQVFCEESGLSPLLQKITDWDSSINLTFHKSKIAVDELFTSLRDIAGARSLLKQFKSVYVPGNHTHQVSRPHPSDYPLLILFVVGGVTVSEVKMVKDLVASLKPGTQVIVLSTRLLKPLNIPELLFATDRLHPDLGF

SEQ ID NO: 76720 - protein, 684 aa, Homo sapiens
  Payload ID: 15320
  Gene Symbol: SCFD2
  Gene Name: sec1 family domain containing 2
  Uniprot ID: Q8WU76
  ENSP ID: ENSP00000384182
MSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQSIGESAMSVVLNQLLPMIKPVTQRTNEDYSPEELLILLIYIYSVTGELTVDKDLCEAEEKVKKALAQVFCEESGLSPLLQKITDWDSSINLTFHKSKIAVDELFTSLRDIAGARSLLKQFKSVYVPGNHTHQASYKPLLKQVVEEIFHPERPDSVDIEHMSSGLTDLLKTGFSMFMKVSRPHPSDYPLLILFVVGGVTVSEVKMVKDLVASLKPGTQVIVLSTRLLKPLNIPELLFATDRLHPDLGF

SEQ ID NO: 76721 - protein, 28 aa, Homo sapiens
  Payload ID: 15320
  Gene Symbol: SCFD2
  Gene Name: sec1 family domain containing 2
  ENSP ID: ENSP00000427202
MVNMIALTALHTEEENYNVVAPGCLSQS

SEQ ID NO: 76722 - protein, 440 aa, Homo sapiens
  Payload ID: 15320
  Gene Symbol: SCFD2
  Gene Name: sec1 family domain containing 2
  ENSP ID: ENSP00000478569
MSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQSIG

SEQ ID NO: 76723 - protein, 179 aa, Homo sapiens
  Payload ID: 15321
  Gene Symbol: SEC11A
  Gene Name: SEC11 homolog A, signal peptidase complex subunit
  Uniprot ID: P67812
  ENSP ID: ENSP00000268220
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 76724 - protein, 153 aa, Homo sapiens
  Payload ID: 15321
  Gene Symbol: SEC11A
  Gene Name: SEC11 homolog A, signal peptidase complex subunit
  Uniprot ID: P67812
  ENSP ID: ENSP00000413121
MIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 76725 - protein, 164 aa, Homo sapiens
  Payload ID: 15321
  Gene Symbol: SEC11A
  Gene Name: SEC11 homolog A, signal peptidase complex subunit
  Uniprot ID: P67812
  ENSP ID: ENSP00000452684
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFYQENSSVEDRNYLFLILEL

SEQ ID NO: 76726 - protein, 185 aa, Homo sapiens
  Payload ID: 15321
  Gene Symbol: SEC11A
  Gene Name: SEC11 homolog A, signal peptidase complex subunit
  Uniprot ID: P67812
  ENSP ID: ENSP00000452697
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGMQFSFCWVYSCWFIVSKKPALLFLGRCHSFRYWMFGVDTGL

SEQ ID NO: 76727 - protein, 129 aa, Homo sapiens
  Payload ID: 15321
  Gene Symbol: SEC11A
  Gene Name: SEC11 homolog A, signal peptidase complex subunit
  ENSP ID: ENSP00000452932
MLSLDFLDDVRRMNKRQLYYQVLNFGMIVSSALMIWKGLMVITGSESPIVVVLRQNGHIKFLTKGDNNAVDDRGLYKQGQHWLEKKDVVGRARGFVPYIGIVTILMNDYPKFKYAVLFLLGLFVLVHRE

SEQ ID NO: 76728 - protein, 135 aa, Homo sapiens
  Payload ID: 15321
  Gene Symbol: SEC11A
  Gene Name: SEC11 homolog A, signal peptidase complex subunit
  ENSP ID: ENSP00000453930
DFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKFVPYIGIVTILMNDYPKFKYAVLFLLGLFVLVHRE

SEQ ID NO: 76729 - protein, 163 aa, Homo sapiens
  Payload ID: 15321
  Gene Symbol: SEC11A
  Gene Name: SEC11 homolog A, signal peptidase complex subunit
  ENSP ID: ENSP00000453997
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGSSVLLRNTSPHLPQFPRCC

SEQ ID NO: 76730 - protein, 106 aa, Homo sapiens
  Payload ID: 15321
  Gene Symbol: SEC11A
  Gene Name: SEC11 homolog A, signal peptidase complex subunit
  ENSP ID: ENSP00000454193
MIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHW

SEQ ID NO: 76731 - protein, 99 aa, Homo sapiens
  Payload ID: 15322
  Gene Symbol: SEC11C
  Gene Name: SEC11 homolog C, signal peptidase complex subunit
  ENSP ID: ENSP00000299714
MVRAGAVGAHLPASGLDIFGDLKKMNKRQLYYQVLNFAMIVSSALMIWKGLIVLTGSESPIVVVLSGSMEPAFHRGDLLFLTNFREDPIRAEIMETSNF

SEQ ID NO: 76732 - protein, 161 aa, Homo sapiens
  Payload ID: 15322
  Gene Symbol: SEC11C
  Gene Name: SEC11 homolog C, signal peptidase complex subunit
  ENSP ID: ENSP00000465281
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGMLFWL

SEQ ID NO: 76733 - protein, 192 aa, Homo sapiens
  Payload ID: 15322
  Gene Symbol: SEC11C
  Gene Name: SEC11 homolog C, signal peptidase complex subunit
  Uniprot ID: Q9BY50
  ENSP ID: ENSP00000468633
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGFLPYVGMVTIIMNDYPKFKYALLAVMGAYVLLKRES

SEQ ID NO: 76734 - protein, 156 aa, Homo sapiens
  Payload ID: 15322
  Gene Symbol: SEC11C
  Gene Name: SEC11 homolog C, signal peptidase complex subunit
  ENSP ID: ENSP00000482872
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARG

SEQ ID NO: 76735 - protein, 322 aa, Homo sapiens
  Payload ID: 15323
  Gene Symbol: SEC13
  Gene Name: SEC13 homolog, nuclear pore and COPII coat complex component
  Uniprot ID: P55735
  ENSP ID: ENSP00000312122
MVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 76736 - protein, 325 aa, Homo sapiens
  Payload ID: 15323
  Gene Symbol: SEC13
  Gene Name: SEC13 homolog, nuclear pore and COPII coat complex component
  ENSP ID: ENSP00000336566
MGKMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 76737 - protein, 368 aa, Homo sapiens
  Payload ID: 15323
  Gene Symbol: SEC13
  Gene Name: SEC13 homolog, nuclear pore and COPII coat complex component
  Uniprot ID: P55735
  ENSP ID: ENSP00000373312
MREPVLTWCVPLELLCSHPLPLSAFLKSQVKLYTYRACAGKDEMGKMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 76738 - protein, 308 aa, Homo sapiens
  Payload ID: 15323
  Gene Symbol: SEC13
  Gene Name: SEC13 homolog, nuclear pore and COPII coat complex component
  Uniprot ID: P55735
  ENSP ID: ENSP00000380298
MIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 76739 - protein, 284 aa, Homo sapiens
  Payload ID: 15323
  Gene Symbol: SEC13
  Gene Name: SEC13 homolog, nuclear pore and COPII coat complex component
  ENSP ID: ENSP00000380306
MIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKEELQMQPQIDHLP

SEQ ID NO: 76740 - protein, 27 aa, Homo sapiens
  Payload ID: 15323
  Gene Symbol: SEC13
  Gene Name: SEC13 homolog, nuclear pore and COPII coat complex component
  ENSP ID: ENSP00000398623
MREPVLTWACAGKDEMGKMVSVINTVD

SEQ ID NO: 76741 - protein, 28 aa, Homo sapiens
  Payload ID: 15323
  Gene Symbol: SEC13
  Gene Name: SEC13 homolog, nuclear pore and COPII coat complex component
  ENSP ID: ENSP00000400260
MREPVLTWACAGKDEMGKMVSVINTVDT

SEQ ID NO: 76742 - protein, 86 aa, Homo sapiens
  Payload ID: 15323
  Gene Symbol: SEC13
  Gene Name: SEC13 homolog, nuclear pore and COPII coat complex component
  ENSP ID: ENSP00000401368
MGKMVSVINTVDTSHEDMIHDAQMDYYGTRLATCSSDRSVKIFDVRNGGQILIADLRGHEGPVWQVAWAHPMYGNILASCSYDRKV

SEQ ID NO: 76743 - protein, 24 aa, Homo sapiens
  Payload ID: 15323
  Gene Symbol: SEC13
  Gene Name: SEC13 homolog, nuclear pore and COPII coat complex component
  ENSP ID: ENSP00000404141
MREPVLTWCVPLELLCSHPLPLSA

SEQ ID NO: 76744 - protein, 106 aa, Homo sapiens
  Payload ID: 15324
  Gene Symbol: SESTD1
  Gene Name: SEC14 and spectrin domains 1
  ENSP ID: ENSP00000334183
  MOD_RES (1)..(1): Any amino acid
XTKESTSLLDELALINNGSDKGNQQEKERSVDLNFLPSVDPETVLQTGHELLSELQQRRFNGSDGGVSWSPMDDELLAQPQVMKLLDSLREQYTRYQEVCREAEKC

SEQ ID NO: 76745 - protein, 93 aa, Homo sapiens
  Payload ID: 15324
  Gene Symbol: SESTD1
  Gene Name: SEC14 and spectrin domains 1
  ENSP ID: ENSP00000387517
MEASVILPILKKKLAFLSGGKDRRSGLILTIPLCLEQTNMDELSVTLDYLLSIPSEKCKARGFTVIVDGRKSQWNVVKTVVVMLQMSCLGLAV

SEQ ID NO: 76746 - protein, 225 aa, Homo sapiens
  Payload ID: 15324
  Gene Symbol: SESTD1
  Gene Name: SEC14 and spectrin domains 1
  ENSP ID: ENSP00000391000
RSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSEWFAVYVELNQQIAALLNAGDEEDLVELKSLQQQLSDVCYRQASQLEFRQNLLQAALEFHGVAQDMWDCKVCVKKVKVSWIRSPIRHPGPMERM

SEQ ID NO: 76747 - protein, 143 aa, Homo sapiens
  Payload ID: 15324
  Gene Symbol: SESTD1
  Gene Name: SEC14 and spectrin domains 1
  ENSP ID: ENSP00000410286
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTE

SEQ ID NO: 76748 - protein, 210 aa, Homo sapiens
  Payload ID: 15324
  Gene Symbol: SESTD1
  Gene Name: SEC14 and spectrin domains 1
  ENSP ID: ENSP00000410632
  MOD_RES (1)..(1): Any amino acid
XQQQLSDVCYRQASQLEFRQNLLQAALEFHGVAQDLSQQLDGLLGMLCVDVAPADGASIQQTLKLLEEKLKSVDVGLQGLREKGQGLLDQISNQASWAYGKDVTIENKENVDHIQGVMEDMQLRKQRCEDMVDVRRLKMLQMVQLFKCEEDAAQAVEWLSELLDALLKTHIRLGDDAQETKVLLEKHRKFVDVAQVQNWLSSFSTSSVFE

SEQ ID NO: 76749 - protein, 696 aa, Homo sapiens
  Payload ID: 15324
  Gene Symbol: SESTD1
  Gene Name: SEC14 and spectrin domains 1
  Uniprot ID: Q86VW0
  ENSP ID: ENSP00000415332
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFGGSLTYDHMDWLNKRLVFEKFTKESTSLLDELALINNGSDKGNQQEKERSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSEWFAVYVELNQQIAALLNAGDEEDLVELKSLQQQLSDVCYRQASQLEFRQNLLQAALEFHGVAQDLSQQLDGLLGMLCVDVAPADGASIQQTLKLLEEKLKSVDVGLQGLREKGQGLLDQISNQASWAYGKDVTIENKENVDHIQGVMEDMQLRKQRCEDMVDVRRLKMLQMVQLFKCEEDAAQAVEWLSELLDALLKTHIRLGDDAQETKVLLEKHRKFVDVAQSTYDYGRQLLQATVVLCQSLRCTSRSSGDTLPRLNRVWKQFTIASEERVHRLEMAIAFHSNAEKILQDCPEEPEAINDEEQFDEIEAVGKSLLDRLTVPVVYPDGTEQYFGSPSDMASTAENIRDRMKLVNLKRQQLRHPEMVTTES

SEQ ID NO: 76750 - protein, 146 aa, Homo sapiens
  Payload ID: 15324
  Gene Symbol: SESTD1
  Gene Name: SEC14 and spectrin domains 1
  ENSP ID: ENSP00000416164
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFG

SEQ ID NO: 76751 - protein, 719 aa, Homo sapiens
  Payload ID: 15325
  Gene Symbol: SEC14L1
  Gene Name: SEC14-like lipid binding 1
  Uniprot ID: Q92503
  ENSP ID: ENSP00000376268
MVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITTSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISRWRFC

SEQ ID NO: 76752 - protein, 681 aa, Homo sapiens
  Payload ID: 15325
  Gene Symbol: SEC14L1
  Gene Name: SEC14-like lipid binding 1
  Uniprot ID: Q92503
  ENSP ID: ENSP00000389838
MFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITTSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 76753 - protein, 715 aa, Homo sapiens
  Payload ID: 15325
  Gene Symbol: SEC14L1
  Gene Name: SEC14-like lipid binding 1
  Uniprot ID: Q92503
  ENSP ID: ENSP00000390392
MVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITTSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 76754 - protein, 719 aa, Homo sapiens; identical to SEQ ID NO: 76751
  Payload ID: 15325
  Gene Symbol: SEC14L1
  Gene Name: SEC14-like lipid binding 1
  Uniprot ID: Q92503
  ENSP ID: ENSP00000406030

SEQ ID NO: 76755 - protein, 715 aa, Homo sapiens; identical to SEQ ID NO: 76753
  Payload ID: 15325
  Gene Symbol: SEC14L1
  Gene Name: SEC14-like lipid binding 1
  Uniprot ID: Q92503
  ENSP ID: ENSP00000408169

SEQ ID NO: 76756 - protein, 118 aa, Homo sapiens
  Payload ID: 15325
  Gene Symbol: SEC14L1
  Gene Name: SEC14-like lipid binding 1
  ENSP ID: ENSP00000464777
YIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPASPTPAP

SEQ ID NO: 76757 - protein, 445 aa, Homo sapiens
  Payload ID: 15325
  Gene Symbol: SEC14L1
  Gene Name: SEC14-like lipid binding 1
  ENSP ID: ENSP00000464973
MVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITTSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLW

SEQ ID NO: 76758 - protein, 15 aa, Homo sapiens
  Payload ID: 15325
  Gene Symbol: SEC14L1
  Gene Name: SEC14-like lipid binding 1
  ENSP ID: ENSP00000465196
MVQKYQSPVRVYKYP

SEQ ID NO: 76759 - protein, 14 aa, Homo sapiens
  Payload ID: 15325
  Gene Symbol: SEC14L1
  Gene Name: SEC14-like lipid binding 1
  ENSP ID: ENSP00000466079
MVQKYQSPVRVYKY

SEQ ID NO: 76760 - protein, 143 aa, Homo sapiens
  Payload ID: 15325
  Gene Symbol: SEC14L1
  Gene Name: SEC14-like lipid binding 1
  ENSP ID: ENSP00000466137
MFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITF

SEQ ID NO: 76761 - protein, 71 aa, Homo sapiens
  Payload ID: 15325
  Gene Symbol: SEC14L1
  Gene Name: SEC14-like lipid binding 1
  ENSP ID: ENSP00000466220
MVQKYQSPVRVYKYPFELIMAAYERRFPTCPLIPMFVGSDTVNEFKSEDGAIHVIERRCKLDVDAPRLLKK

SEQ ID NO: 76762 - protein, 715 aa, Homo sapiens; identical to SEQ ID NO: 76753
  Payload ID: 15325
  Gene Symbol: SEC14L1
  Gene Name: SEC14-like lipid binding 1
  Uniprot ID: Q92503
  ENSP ID: ENSP00000466581

SEQ ID NO: 76763 - protein, 156 aa, Homo sapiens
  Payload ID: 15325
  Gene Symbol: SEC14L1
  Gene Name: SEC14-like lipid binding 1
  ENSP ID: ENSP00000467347
VHPENEDWTCFEQSASLDIKSFFGFESTVEKIAMKQYTSNIKKGKEIIEYYLRQLEEEGITFVPRWSPPSITTSSETSSSSSKKQAASMAVVIPEAALKEGLSGDALSSPSAPEPVVGTPDGGSGRGFIPRARLGKSALPFSLCLLCLFPLPWNIR

SEQ ID NO: 76764 - protein, 60 aa, Homo sapiens
  Payload ID: 15325
  Gene Symbol: SEC14L1
  Gene Name: SEC14-like lipid binding 1
  ENSP ID: ENSP00000467868
MVQKYQSPVRVYKYPFELIMAAYERRFPTCPLIPMFVGSDTVNEFKSEDGAIHVIERRCK

SEQ ID NO: 76765 - protein, 681 aa, Homo sapiens; identical to SEQ ID NO: 76752
  Payload ID: 15325
  Gene Symbol: SEC14L1
  Gene Name: SEC14-like lipid binding 1
  Uniprot ID: Q92503
  ENSP ID: ENSP00000467934

SEQ ID NO: 76766 - protein, 83 aa, Homo sapiens
  Payload ID: 15325
  Gene Symbol: SEC14L1
  Gene Name: SEC14-like lipid binding 1
  ENSP ID: ENSP00000468184
MVQKYQSPVRVYKYPFELIMAAYERRFPTCPLIPMFVGSDTVNEFKSEDGAIHVIERRCKLDVDAPRLLKKELIMFILSRKTH

SEQ ID NO: 76767 - protein, 89 aa, Homo sapiens
  Payload ID: 15325
  Gene Symbol: SEC14L1
  Gene Name: SEC14-like lipid binding 1
  ENSP ID: ENSP00000468727
AYERRFPTCPLIPMFVGSDTVNEFKSEDGAIHVIERRCKLDVDAPRLLKKIAGVDYVYFVQKNSLNSRERTLHIEAYNETAFSLSAGSP

SEQ ID NO: 76768 - protein, 320 aa, Homo sapiens
  Payload ID: 15326
  Gene Symbol: SEC14L2
  Gene Name: SEC14-like lipid binding 2
  Uniprot ID: O76054
  ENSP ID: ENSP00000383882
MSGRVGDLSPRQKEALAKFRENVQDVLPALPNPDDYFLLRWLRARSFDLQKSEAMLRKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 76769 - protein, 392 aa, Homo sapiens
  Payload ID: 15326
  Gene Symbol: SEC14L2
  Gene Name: SEC14-like lipid binding 2
  Uniprot ID: O76054
  ENSP ID: ENSP00000385186
MSGRVGDLSPRQKEALAKFRENVQDVLPALPNPDDYFLLRWLRARSFDLQKSEAMLRKHVEFRKQKDIDNIISWQPPEVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGICKYLCLGNALKPHVQLSACEVPLPPWIFGSEC

SEQ ID NO: 76770 - protein, 203 aa, Homo sapiens
  Payload ID: 15326
  Gene Symbol: SEC14L2
  Gene Name: SEC14-like lipid binding 2
  ENSP ID: ENSP00000387781
MLRKHVEFRKQKDIDNIISWQPPEVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSK

SEQ ID NO: 76771 - protein, 84 aa, Homo sapiens
  Payload ID: 15326
  Gene Symbol: SEC14L2
  Gene Name: SEC14-like lipid binding 2
  ENSP ID: ENSP00000388719
MSGRVGDLSPRQKEALAKFRENVQDVLPALPNPDDYFLLRWLRARSFDLQKSEAMLRKHVEFRKQKDIDNIISWQPPEPPNRTC

SEQ ID NO: 76772 - protein, 53 aa, Homo sapiens
  Payload ID: 15326
  Gene Symbol: SEC14L2
  Gene Name: SEC14-like lipid binding 2
  ENSP ID: ENSP00000388888
MSGRVGDLSPRQKEALAKPEASTCRSRRPCSGSMWSSESKRTLTTSLAGSLQR

SEQ ID NO: 76773 - protein, 125 aa, Homo sapiens
  Payload ID: 15326
  Gene Symbol: SEC14L2
  Gene Name: SEC14-like lipid binding 2
  ENSP ID: ENSP00000399596
MPCFIGSRVRPPLSSLCSPANSSSFHGAEDHGGKSVCSGLRQTRFRENVQDVLPALPNPDDYFLLRWLRARSFDLQKSEAMLRKHVEFRKQKDIDNIISWQPPEVIQQYLSGGMCGYDLDGCPVW

SEQ ID NO: 76774 - protein, 84 aa, Homo sapiens
  Payload ID: 15326
  Gene Symbol: SEC14L2
  Gene Name: SEC14-like lipid binding 2
  ENSP ID: ENSP00000407857
MLLRRQEARSFDLQKSEAMLRKHVEFRKQKDIDNIISWQPPEVIQQYLSGGMCGYDLDGCPVWYDIIGPLDAKGLLFSASKQDL

SEQ ID NO: 76775 - protein, 403 aa, Homo sapiens
  Payload ID: 15326
  Gene Symbol: SEC14L2
  Gene Name: SEC14-like lipid binding 2
  Uniprot ID: O76054
  ENSP ID: ENSP00000478755
MSGRVGDLSPRQKEALAKFRENVQDVLPALPNPDDYFLLRWLRARSFDLQKSEAMLRKHVEFRKQKDIDNIISWQPPEVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 76776 - protein, 329 aa, Homo sapiens
  Payload ID: 15326
  Gene Symbol: SEC14L2
  Gene Name: SEC14-like lipid binding 2
  ENSP ID: ENSP00000482467
MLRKVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 76777 - protein, 400 aa, Homo sapiens
  Payload ID: 15327
  Gene Symbol: SEC14L3
  Gene Name: SEC14-like lipid binding 3
  Uniprot ID: Q9UDX4
  ENSP ID: ENSP00000215812
MSGRVGDLSPKQAETLAKFRENVQDVLPALPNPDDYFLLRWLRARNFDLQKSEALLRKYMEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 76778 - protein, 341 aa, Homo sapiens
  Payload ID: 15327
  Gene Symbol: SEC14L3
  Gene Name: SEC14-like lipid binding 3
  Uniprot ID: Q9UDX4
  ENSP ID: ENSP00000383896
MEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 76779 - protein, 323 aa, Homo sapiens
  Payload ID: 15327
  Gene Symbol: SEC14L3
  Gene Name: SEC14-like lipid binding 3
  Uniprot ID: Q9UDX4
  ENSP ID: ENSP00000385004
MVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 76780 - protein, 353 aa, Homo sapiens
  Payload ID: 15327
  Gene Symbol: SEC14L3
  Gene Name: SEC14-like lipid binding 3
  ENSP ID: ENSP00000385941
MEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVESESGKSCCHLPVIICSHELQNSHSNSQVMAYQMVRKCKLSRPLPLPASN

SEQ ID NO: 76781 - protein, 231 aa, Homo sapiens
  Payload ID: 15327
  Gene Symbol: SEC14L3
  Gene Name: SEC14-like lipid binding 3
  ENSP ID: ENSP00000402986
  MOD_RES (1)..(1): Any amino acid
XKTSRMCFLPCPTLMIISFYAGSEYMEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIP

SEQ ID NO: 76782 - protein, 51 aa, Homo sapiens
  Payload ID: 15327
  Gene Symbol: SEC14L3
  Gene Name: SEC14-like lipid binding 3
  ENSP ID: ENSP00000405055
MSGRVGDLSPKQAETLAKMESLSSRLECCGAISAHCSLCLPGSSNSPASAS

SEQ ID NO: 76783 - protein, 323 aa, Homo sapiens; identical to SEQ ID NO: 76779
  Payload ID: 15327
  Gene Symbol: SEC14L3
  Gene Name: SEC14-like lipid binding 3
  Uniprot ID: Q9UDX4
  ENSP ID: ENSP00000439752

SEQ ID NO: 76784 - protein, 406 aa, Homo sapiens
  Payload ID: 15328
  Gene Symbol: SEC14L4
  Gene Name: SEC14-like lipid binding 4
  Uniprot ID: Q9UDX3
  ENSP ID: ENSP00000255858
MSSRVGDLSPQQQEALARFRENLQDLLPILPNADDYFLLRWLRARNFDLQKSEDMLRRHMEFRKQQDLDNIVTWQPPEVIQLYDSGGLCGYDYEGCPVYFNIIGSLDPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQAGVYVLRFDNTYSRMHAKKLSYTVEVLLPDKASEETLQSLKAMRPSPTQ

SEQ ID NO: 76785 - protein, 38 aa, Homo sapiens
  Payload ID: 15328
  Gene Symbol: SEC14L4
  Gene Name: SEC14-like lipid binding 4
  ENSP ID: ENSP00000314163
MSSRVGDLSPQQQEALARILLRSVPGEPPGPAAHTAQC

SEQ ID NO: 76786 - protein, 93 aa, Homo sapiens
  Payload ID: 15328
  Gene Symbol: SEC14L4
  Gene Name: SEC14-like lipid binding 4
  ENSP ID: ENSP00000317617
MSSRVGDLSPQQQEALARFRENLQDLLPILPNADDYFLLRWLRARNFDLQKSEDMLRRTQVPPAHLLSPRSESLAHGVPEATRPGQHCHMAAP

SEQ ID NO: 76787 - protein, 360 aa, Homo sapiens
  Payload ID: 15328
  Gene Symbol: SEC14L4
  Gene Name: SEC14-like lipid binding 4
  Uniprot ID: Q9UDX3
  ENSP ID: ENSP00000371412
MSSRVGDLSPQQQEALARFRENLQDLLPILPNADDYFLLRWLRARNFDLQKSEDMLRRHMEFRKQQDLDNIVTWQPPEVIQLYDSGGLCGYDYEGCPVYFNIIGSLDPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQAGV

SEQ ID NO: 76788 - protein, 696 aa, Homo sapiens
  Payload ID: 15329
  Gene Symbol: SEC14L5
  Gene Name: SEC14-like lipid binding 5
  Uniprot ID: O43304
  ENSP ID: ENSP00000251170
MVQRYQSPVRVYKYPFELVMAAYEKRFPTCPQIPVFLGSEVLRESRSPDGAVHVVERSCRLRVDAPRLLRKIAGVEHVVFVQTNILNWKERTLLIEAHNETFANRVVVNEHCSYTVHPENEDWTCFEQSASLDIRSFFGFENALEKIAMKQYTANVKRGKEVIEHYLNELISQGTSHIPRWTPAPVREEDARNQAGPRDPSSLEAHGPRSTLGPALEAVSMDGDKLDADYIERCLGHLTPMQESCLIQLRHWLQETHKGKIPKDEHILRFLRAHDFHLDKAREMLRQSLSWRKQHQVDLLLQTWQPPALLEEFYAGGWHYQDIDGRPLYILRLGQMDTKGLMKAVGEEALLRHVLSVNEEGQKRCEGSTRQLGRPISSWTCLLDLEGLNMRHLWRPGVKALLRMIEVVEDNYPETLGRLLIVRAPRVFPVLWTLISPFINENTRRKFLIYSGSNYQGPGGLVDYLDREVIPDFLGGESVCNVPEGGLVPKSLYMTEEEQEHTDQLWQWSETYHSASVLRGAPHEVAVEILEGESVITWDFDILRGDVVFSLYHTKQAPRLGAREPGTRASGQLIDKGWVLGRDYSRVEAPLVCREGESIQGSHVTRWPGVYLLQWQMHSPPSSVACSLPGVDDVLTALHSPGPKCKLLYYCEVLASEDFRGSMSSLESCTSGFSQLSAATSSSSSGQSHSSSLVSR

SEQ ID NO: 76789 - protein, 169 aa, Homo sapiens
  Payload ID: 15329
  Gene Symbol: SEC14L5
  Gene Name: SEC14-like lipid binding 5
  ENSP ID: ENSP00000468423
MVQRYQSPVRVYKYPFELVMAAYEKRFPTCPQIPVFLGSEVLRESRSPDGAVHVVERSCRLRVDAPRLLRKIAGVEHVVFVQTNILNWKERTLLIEAHNETFANRVVVNEHCSYTVHPENEDWTCFEQSASLDIRSFFGFENALEKIAMKQYTANVKRGKEVIEHYLNE

SEQ ID NO: 76790 - protein, 397 aa, Homo sapiens
  Payload ID: 15330
  Gene Symbol: SEC14L6
  Gene Name: SEC14-like lipid binding 6
  Uniprot ID: B5MCN3
  ENSP ID: ENSP00000385695
MSGQVGDLSPSQEKSLAQFRENIQDVLSALPNPDDYFLLRWLQARSFDLQKSEDMLRKHMEFRKQQDLANILAWQPPEVVRLYNANGICGHDGEGSPVWYHIVGSLDPKGLLLSASKQELLRDSFRSCELLLRECELQSQKLGKRVEKIIAIFGLEGLGLRDLWKPGIELLQEFFSALEANYPEILKSLIVVRAPKLFAVAFNLVKSYMSEETRRKVVILGDNWKQELTKFISPDQLPVEFGGTMTDPDGNPKCLTKINYGGEVPKSYYLCKQVRLQYEHTRSVGRGSSLQVENEILFPGCVLRWQFASDGGDIGFGVFLKTKMGERQRAREMTEVLPSQRYNAHMVPEDGILTCLQAGSYVLRFYNTYSLVHSKRISYTVEVLLPDQTFMEKMEKF

SEQ ID NO: 76791 - protein, 122 aa, Homo sapiens
  Payload ID: 15330
  Gene Symbol: SEC14L6
  Gene Name: SEC14-like lipid binding 6
  ENSP ID: ENSP00000393380
  MOD_RES (1)..(1): Any amino acid
XLFAVAFNLVKSYMSEETRRKVVILGDNWKQELTKFISPDQLPVEFGGTMTDPDGNPKCLTKINYGGEVPKSYYLCKQVRLQYEHTRSVGRGSSLQVENEILFPGCVLRCPEVLQHLQPGSF

SEQ ID NO: 76792 - protein, 751 aa, Homo sapiens
  Payload ID: 15331
  Gene Symbol: SEC16A
  Gene Name: SEC16 homolog A, endoplasmic reticulum export factor
  ENSP ID: ENSP00000277537
PAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 76793 - protein, 2334 aa, Homo sapiens
  Payload ID: 15331
  Gene Symbol: SEC16A
  Gene Name: SEC16 homolog A, endoplasmic reticulum export factor
  ENSP ID: ENSP00000290037
MQPPPQTVPSGMAGPPPAGNPRSVFWASSPYRRRANNNAAVAPTTCPLQPVTDPFAFSRQALQSTPLGSSSKSSPPVLQGPAPAGFSQHPGLLVPHTHARDSSQGPCEPLPGPLTQPRAHASPFSGALTPSAPPGPEMNRSAEVGPSSEPEVQTLPYLPHYIPGVDPETSHGGHPHGNMPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPVSSVRPQGRSGRNDGLLALSSPDAEEPQLPDGTGREGPAAARGLANPEPAPEPKAPGDLPAAGGPPSGAMPFYNPAQLAQACATSGSSRLGRIGQRKHLVLN

SEQ ID NO: 76794 - protein, 385 aa, Homo sapiens
  Payload ID: 15331
  Gene Symbol: SEC16A
  Gene Name: SEC16 homolog A, endoplasmic reticulum export factor
  ENSP ID: ENSP00000317437
MDLLPTSILLASLWICSHLHPPGVSVDLPPTSILLVSLWICSHLHPPGVSVDRPPPPSSWCLCGSPPTSILLVSLWICSPPPSSWCLCGSAPTSILLVSLWIWRLWGLTEGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPVSSVRPQGRSGRNDGLLALSSPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 76795 - protein, 2357 aa, Homo sapiens
  Payload ID: 15331
  Gene Symbol: SEC16A
  Gene Name: SEC16 homolog A, endoplasmic reticulum export factor
  ENSP ID: ENSP00000325827
MQPPPQTVPSGMAGPPPAGNPRSVFWASSPYRRRANNNAAVAPTTCPLQPVTDPFAFSRQALQSTPLGSSSKSSPPVLQGPAPAGFSQHPGLLVPHTHARDSSQGPCEPLPGPLTQPRAHASPFSGALTPSAPPGPEMNRSAEVGPSSEPEVQTLPYLPHYIPGVDPETSHGGHPHGNMPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 76796 - protein, 2134 aa, Homo sapiens
  Payload ID: 15331
  Gene Symbol: SEC16A
  Gene Name: SEC16 homolog A, endoplasmic reticulum export factor
  Uniprot ID: O15027
  ENSP ID: ENSP00000360771
MPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKAPGDLPAAGGPPSGAMPFYNPAQLAQACATSGSSRLGRIGQRKHLVLN

SEQ ID NO: 76797 - protein, 2154 aa, Homo sapiens
  Payload ID: 15331
  Gene Symbol: SEC16A
  Gene Name: SEC16 homolog A, endoplasmic reticulum export factor
  Uniprot ID: O15027
  ENSP ID: ENSP00000387583
MPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKLSRCSSMSSLSREVSQHFNQAPGDLPAAGGPPSGAMPFYNPAQLAQACATSGSSRLGRIGQRKHLVLN

SEQ ID NO: 76798 - protein, 1059 aa, Homo sapiens
  Payload ID: 15331
  Gene Symbol: SEC16A
  Gene Name: SEC16 homolog A, endoplasmic reticulum export factor
  ENSP ID: ENSP00000403525
ARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 76799 - protein, 1060 aa, Homo sapiens
  Payload ID: 15332
  Gene Symbol: SEC16B
  Gene Name: SEC16 homolog B, endoplasmic reticulum export factor
  Uniprot ID: Q96JE7
  ENSP ID: ENSP00000308339
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQADVSSAGPKAPMKFYIPHVPVSFGPGGQLVHVGPSSPTDGQAALVELHSMEVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 76800 - protein, 625 aa, Homo sapiens
  Payload ID: 15332
  Gene Symbol: SEC16B
  Gene Name: SEC16 homolog B, endoplasmic reticulum export factor
  ENSP ID: ENSP00000431727
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQAEDVSSAGPKAPMKFYIPHVPVSFGPGGQLVHVGPSSPTDGQAALVELHSMEVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHRYATWEKGNSKDIFQGTVLALVGFYGSIFHFLM

SEQ ID NO: 76801 - protein, 175 aa, Homo sapiens
  Payload ID: 15332
  Gene Symbol: SEC16B
  Gene Name: SEC16 homolog B, endoplasmic reticulum export factor
  ENSP ID: ENSP00000435101
  MOD_RES (1)..(1): Any amino acid
XLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKCCGEKQWGDWRPHLAVILSNQAGDPELYQRAIVAIGDTLAGKGLVEAAHFCYLMAHVPFGHYTVKTDHLVLLGSSH

SEQ ID NO: 76802 - protein, 316 aa, Homo sapiens
  Payload ID: 15332
  Gene Symbol: SEC16B
  Gene Name: SEC16 homolog B, endoplasmic reticulum export factor
  ENSP ID: ENSP00000475522
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQADVSSAGPKAPMKFYIPHVPVSFGPGGQLVHVGPSSPTDGQAALVELHSMEGRCT

SEQ ID NO: 76803 - protein, 307 aa, Homo sapiens
  Payload ID: 15333
  Gene Symbol: SEC22A
  Gene Name: SEC22 homolog A, vesicle trafficking protein
  Uniprot ID: Q96IW7
  ENSP ID: ENSP00000310521
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQCYLLVYYTGWRNVKSFLTFGLICLCNMYLYELRNLWQLFFHVTVGAFVTLQIWLRQAQGKAPDYDV

SEQ ID NO: 76804 - protein, 71 aa, Homo sapiens
  Payload ID: 15333
  Gene Symbol: SEC22A
  Gene Name: SEC22 homolog A, vesicle trafficking protein
  ENSP ID: ENSP00000417200
MSMILSASVIRVRDGLPLSASTDYEQSTGMQECRKYFKMLSRKLAQLPDRCTLKTGHYNINFRRSSLLLIT

SEQ ID NO: 76805 - protein, 101 aa, Homo sapiens
  Payload ID: 15333
  Gene Symbol: SEC22A
  Gene Name: SEC22 homolog A, vesicle trafficking protein
  ENSP ID: ENSP00000417219
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMM

SEQ ID NO: 76806 - protein, 307 aa, Homo sapiens; identical to SEQ ID NO: 76803
  Payload ID: 15333
  Gene Symbol: SEC22A
  Gene Name: SEC22 homolog A, vesicle trafficking protein
  Uniprot ID: Q96IW7
  ENSP ID: ENSP00000417972

SEQ ID NO: 76807 - protein, 108 aa, Homo sapiens
  Payload ID: 15333
  Gene Symbol: SEC22A
  Gene Name: SEC22 homolog A, vesicle trafficking protein
  ENSP ID: ENSP00000419039
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVR

SEQ ID NO: 76808 - protein, 218 aa, Homo sapiens
  Payload ID: 15333
  Gene Symbol: SEC22A
  Gene Name: SEC22 homolog A, vesicle trafficking protein
  ENSP ID: ENSP00000420015
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLL

SEQ ID NO: 76809 - protein, 99 aa, Homo sapiens
  Payload ID: 15333
  Gene Symbol: SEC22A
  Gene Name: SEC22 homolog A, vesicle trafficking protein
  ENSP ID: ENSP00000420128
MSMILSASVIRVRDGLPLSASTDYEQSTGMQECRKYFKMLSRKLAQLPDRCTLKTGHYNIKVMVMILITSLHFSLEQQPAFTSVIYLSTTPAGGMSNLF

SEQ ID NO: 76810 - protein, 288 aa, Homo sapiens
  Payload ID: 15333
  Gene Symbol: SEC22A
  Gene Name: SEC22 homolog A, vesicle trafficking protein
  ENSP ID: ENSP00000420343
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQCYLLVYYTGWRNVKSFLTFGLICLCNMYLYELRNLWQLFFHVTVGAF

SEQ ID NO: 76811 - protein, 138 aa, Homo sapiens
  Payload ID: 15333
  Gene Symbol: SEC22A
  Gene Name: SEC22 homolog A, vesicle trafficking protein
  ENSP ID: ENSP00000420574
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINL

SEQ ID NO: 76812 - protein, 215 aa, Homo sapiens
  Payload ID: 15334
  Gene Symbol: SEC22B
  Gene Name: SEC22 homolog B, vesicle trafficking protein (gene/pseudogene)
  Uniprot ID: O75396
  ENSP ID: ENSP00000463393
MVLLTMIARVADGLPLAASMQEDEQSGRDLQQYQSQAKQLFRKLNEQSPTRCTLEAGAMTFHYIIEQGVCYLVLCEAAFPKKLAFAYLEDLHSEFDEQHGKKVPTVSRPYSFIEFDTFIQKTKKLYIDSRARRNLGSINTELQDVQRIMVANIEEVLQRGEALSALDSKANNLSSLSKKYRQDAKYLNMRSTYAKLAAVAVFFIMLIVYVRFWWL

SEQ ID NO: 76813 - protein, 79 aa, Homo sapiens
  Payload ID: 15334
  Gene Symbol: SEC22B
  Gene Name: SEC22 homolog B, vesicle trafficking protein (gene/pseudogene)
  ENSP ID: ENSP00000484017
YIDSRARRNLGSINTELQDVQRIMVANIEEVLQRGEALSGWSAMARSWLTATTISWVQAIFPPYPPEYLGLQACATTPG

SEQ ID NO: 76814 - protein, 303 aa, Homo sapiens
  Payload ID: 15335
  Gene Symbol: SEC22C
  Gene Name: SEC22 homolog C, vesicle trafficking protein
  Uniprot ID: Q9BRL7
  ENSP ID: ENSP00000264454
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQCYLYLFYSPARTMKVVLMLLFICLGNMYLHGLRNLWQILFHIGVAFLSSYQILTRQLQEKQSDCGV

SEQ ID NO: 76815 - protein, 250 aa, Homo sapiens
  Payload ID: 15335
  Gene Symbol: SEC22C
  Gene Name: SEC22 homolog C, vesicle trafficking protein
  Uniprot ID: Q9BRL7
  ENSP ID: ENSP00000273156
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 76816 - protein, 72 aa, Homo sapiens
  Payload ID: 15335
  Gene Symbol: SEC22C
  Gene Name: SEC22 homolog C, vesicle trafficking protein
  ENSP ID: ENSP00000373256
MSVIFFACVVRVRDGLPLSASTDFYHTQDFLEWRRRLKSLALRLAQYPGRGSAEGCDFSIQDKVLPCCPGWS

SEQ ID NO: 76817 - protein, 143 aa, Homo sapiens
  Payload ID: 15335
  Gene Symbol: SEC22C
  Gene Name: SEC22 homolog C, vesicle trafficking protein
  ENSP ID: ENSP00000389589
MSVIFFACVVRVRDGLPLSASTDFYHTQDFLEWRRRLKSLALRLAQYPGRGSAEGCDFSIQHFKGSGRKTVSGIGRTEETIYLQQTATGLFKAKQVQNSVFLLSGTWPAWLSAPASVQQPWPSASWRPCGGNSQLPMTLPALA

SEQ ID NO: 76818 - protein, 236 aa, Homo sapiens
  Payload ID: 15335
  Gene Symbol: SEC22C
  Gene Name: SEC22 homolog C, vesicle trafficking protein
  ENSP ID: ENSP00000391170
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIF

SEQ ID NO: 76819 - protein, 107 aa, Homo sapiens
  Payload ID: 15335
  Gene Symbol: SEC22C
  Gene Name: SEC22 homolog C, vesicle trafficking protein
  ENSP ID: ENSP00000391957
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLAS

SEQ ID NO: 76820 - protein, 142 aa, Homo sapiens
  Payload ID: 15335
  Gene Symbol: SEC22C
  Gene Name: SEC22 homolog C, vesicle trafficking protein
  ENSP ID: ENSP00000397170
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQ

SEQ ID NO: 76821 - protein, 72 aa, Homo sapiens; identical to SEQ ID NO: 76816
  Payload ID: 15335
  Gene Symbol: SEC22C
  Gene Name: SEC22 homolog C, vesicle trafficking protein
  ENSP ID: ENSP00000404987

SEQ ID NO: 76822 - protein, 250 aa, Homo sapiens; identical to SEQ ID NO: 76815
  Payload ID: 15335
  Gene Symbol: SEC22C
  Gene Name: SEC22 homolog C, vesicle trafficking protein
  Uniprot ID: Q9BRL7
  ENSP ID: ENSP00000407564

SEQ ID NO: 76823 - protein, 75 aa, Homo sapiens
  Payload ID: 15335
  Gene Symbol: SEC22C
  Gene Name: SEC22 homolog C, vesicle trafficking protein
  ENSP ID: ENSP00000408242
MSVIFFACVVRVRDGLPLSASTDFYHTQDFLEWRRRLKSLALRLAQYPGRGSAEGCDFSIQLLDILKEAEERQSQ

SEQ ID NO: 76824 - protein, 61 aa, Homo sapiens
  Payload ID: 15335
  Gene Symbol: SEC22C
  Gene Name: SEC22 homolog C, vesicle trafficking protein
  ENSP ID: ENSP00000411725
MSVIFFACVVRVRDGLPLSASTDFYHTQDFLEWRRRLKSLALRLAQYPGRGSAEGCDFSIQ

SEQ ID NO: 76825 - protein, 228 aa, Homo sapiens
  Payload ID: 15335
  Gene Symbol: SEC22C
  Gene Name: SEC22 homolog C, vesicle trafficking protein
  Uniprot ID: Q9BRL7
  ENSP ID: ENSP00000414576
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQDPRSWFCWLDQTS

SEQ ID NO: 76826 - protein, 225 aa, Homo sapiens
  Payload ID: 15335
  Gene Symbol: SEC22C
  Gene Name: SEC22 homolog C, vesicle trafficking protein
  ENSP ID: ENSP00000415969
  MOD_RES (1)..(1): Any amino acid
XAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQCYLYLFYSPARTMKVVLMLLFICLGNMYLHGLRNLWQILFHIGVAFLSSYQILTRQLQEKQSDCGV

SEQ ID NO: 76827 - protein, 765 aa, Homo sapiens
  Payload ID: 15336
  Gene Symbol: SEC23A
  Gene Name: Sec23 homolog A, COPII coat complex component
  Uniprot ID: Q15436
  ENSP ID: ENSP00000306881
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPLTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 76828 - protein, 563 aa, Homo sapiens
  Payload ID: 15336
  Gene Symbol: SEC23A
  Gene Name: Sec23 homolog A, COPII coat complex component
  Uniprot ID: Q15436
  ENSP ID: ENSP00000444193
MLGLSKVPLTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 76829 - protein, 736 aa, Homo sapiens
  Payload ID: 15336
  Gene Symbol: SEC23A
  Gene Name: Sec23 homolog A, COPII coat complex component
  ENSP ID: ENSP00000445393
MTTYLEFIQQNEERDGVRFSWNVWPSSRLEATRMVVPVAALFTPLKERPDLPPIQYEPVLCSRTTCRAVLNPLCQVDYRAKLWACNFCYQRNQRGPQMPLIFLYVVDTCMEDEDLQALKESMQMSLSLLPPTALVGLITFGRMVQVHELGCEGISKSYVFRGTKDLSAKQLQEMLGLSKVPLTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 76830 - protein, 108 aa, Homo sapiens
  Payload ID: 15336
  Gene Symbol: SEC23A
  Gene Name: Sec23 homolog A, COPII coat complex component
  ENSP ID: ENSP00000447489
MTTYLEFIQQNEERDGVRFSWNVWPSSRLEATRMVVPVAALFTPLKERPDLPPIQYEPVLCSRTTCRAVLNPLCQVDYRAKLWACNFCYQRNQVRKHPLHAGRSGSCL

SEQ ID NO: 76831 - protein, 169 aa, Homo sapiens
  Payload ID: 15336
  Gene Symbol: SEC23A
  Gene Name: Sec23 homolog A, COPII coat complex component
  ENSP ID: ENSP00000450819
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITF

SEQ ID NO: 76832 - protein, 140 aa, Homo sapiens
  Payload ID: 15336
  Gene Symbol: SEC23A
  Gene Name: Sec23 homolog A, COPII coat complex component
  ENSP ID: ENSP00000451230
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCME

SEQ ID NO: 76833 - protein, 86 aa, Homo sapiens
  Payload ID: 15336
  Gene Symbol: SEC23A
  Gene Name: Sec23 homolog A, COPII coat complex component
  ENSP ID: ENSP00000451924
MTTYLEFIQQNEERDGVRFSWNVWPSSRLEATRMVVPVAALFTPLKERPDLPPIQYEPVLCSRTTCRAVLNPLCSLFSTQKLEFYE

SEQ ID NO: 76834 - protein, 93 aa, Homo sapiens
  Payload ID: 15336
  Gene Symbol: SEC23A
  Gene Name: Sec23 homolog A, COPII coat complex component
  ENSP ID: ENSP00000451999
MTTYLEFIQQNEERDGVRFSWNVWPSSRLEATRMVVPVAALFTPLKERPDLPPIQYEPVLCSRTTCRAVLNPLCQVDYRAKLWACNFCYQRNQ

SEQ ID NO: 76835 - protein, 40 aa, Homo sapiens
  Payload ID: 15336
  Gene Symbol: SEC23A
  Gene Name: Sec23 homolog A, COPII coat complex component
  ENSP ID: ENSP00000452390
MTTYLEFIQQNEERDGVRFSWNVWPSSRLEATRMVVPVAA

SEQ ID NO: 76836 - protein, 85 aa, Homo sapiens
  Payload ID: 15336
  Gene Symbol: SEC23A
  Gene Name: Sec23 homolog A, COPII coat complex component
  ENSP ID: ENSP00000452575
MTTYLEFIQQNEERDGVRFSWNVWPSSRLEATRMVVPVAALFTPLKERPDLPPIQYEPVLCSRTTCRAVLNPLCLFSTQKLEFYE

SEQ ID NO: 76837 - protein, 86 aa, Homo sapiens; identical to SEQ ID NO: 76833
  Payload ID: 15336
  Gene Symbol: SEC23A
  Gene Name: Sec23 homolog A, COPII coat complex component
  ENSP ID: ENSP00000486142

SEQ ID NO: 76838 - protein, 767 aa, Homo sapiens
  Payload ID: 15337
  Gene Symbol: SEC23B
  Gene Name: Sec23 homolog B, COPII coat complex component
  Uniprot ID: Q15437
  ENSP ID: ENSP00000262544
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKHYEMLANRTAANGHCIDIYACALDQTGLLEMKCCANLTGGYMVMGDSFNTSLFKQTFQRIFTKDFNGDFRMAFGATLDVKTSRELKIAGAIGPCVSLNVKGPCVSENELGVGGTSQWKICGLDPTSTLGIYFEVVNQHNTPIPQGGRGAIQFVTHYQHSSTQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPEPVLLDSSSILADRILLMDTFFQIVIYLGETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 76839 - protein, 767 aa, Homo sapiens; identical to SEQ ID NO: 76838
  Payload ID: 15337
  Gene Symbol: SEC23B
  Gene Name: Sec23 homolog B, COPII coat complex component
  Uniprot ID: Q15437
  ENSP ID: ENSP00000338844

SEQ ID NO: 76840 - protein, 767 aa, Homo sapiens; identical to SEQ ID NO: 76838
  Payload ID: 15337
  Gene Symbol: SEC23B
  Gene Name: Sec23 homolog B, COPII coat complex component
  Uniprot ID: Q15437
  ENSP ID: ENSP00000366685

SEQ ID NO: 76841 - protein, 767 aa, Homo sapiens; identical to SEQ ID NO: 76838
  Payload ID: 15337
  Gene Symbol: SEC23B
  Gene Name: Sec23 homolog B, COPII coat complex component
  Uniprot ID: Q15437
  ENSP ID: ENSP00000366695

SEQ ID NO: 76842 - protein, 331 aa, Homo sapiens
  Payload ID: 15337
  Gene Symbol: SEC23B
  Gene Name: Sec23 homolog B, COPII coat complex component
  ENSP ID: ENSP00000403971
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATK

SEQ ID NO: 76843 - protein, 246 aa, Homo sapiens
  Payload ID: 15337
  Gene Symbol: SEC23B
  Gene Name: Sec23 homolog B, COPII coat complex component
  ENSP ID: ENSP00000409882
QRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 76844 - protein, 1000 aa, Homo sapiens
  Payload ID: 15338
  Gene Symbol: SEC23IP
  Gene Name: SEC23 interacting protein
  Uniprot ID: Q9Y6Y8
  ENSP ID: ENSP00000358071
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEAEYKKAVTTNQWHRRLEFPSGETIVMHNPKVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENKEVLTLQETLEALSLSEYFSTFEKEKIDMESLLMCTVDDLKEMGIPLGPRKKIANFVEHKAAKLKKAASEKKAVAATSTKGQEQSAQKTKDMASLPSESNEPKRKLPVGACVSSVCVNYESFEVGAGQVSVAYNSLDFEPEIFFALGSPIAMFLTIRGVDRIDENYSLPTCKGFFNIYHPLDPVAYRLEPMIVPDLDLKAVLIPHHKGRKRLHLELKESLSRMGSDLKQGFISSLKSAWQTLNEFARAHTSSTQLQEELEKVANQIKEEEEKQVVEAEKVVESPDFSKDEDYLGKVGMLNGGRRIDYVLQEKPIESFNEYLFALQSHLCYWESEDTALLLLKEIYRTMNISPEQPQH

SEQ ID NO: 76845 - protein, 194 aa, Homo sapiens
  Payload ID: 15338
  Gene Symbol: SEC23IP
  Gene Name: SEC23 interacting protein
  ENSP ID: ENSP00000396906
EPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDG

SEQ ID NO: 76846 - protein, 153 aa, Homo sapiens
  Payload ID: 15338
  Gene Symbol: SEC23IP
  Gene Name: SEC23 interacting protein
  ENSP ID: ENSP00000416723
  MOD_RES (1)..(1): Any amino acid
XSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEVRVLYFFMSFFKKCRSYIHW

SEQ ID NO: 76847 - protein, 486 aa, Homo sapiens
  Payload ID: 15338
  Gene Symbol: SEC23IP
  Gene Name: SEC23 interacting protein
  ENSP ID: ENSP00000438773
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEAEYKKAVTTNQWHRRLEFPSGETIVMHNPKVIVQFQPSSVPDEWGTTQDGQTRPRVVKRGIDDNLDEIPDGEMPQVDHLVFVVHGIGPVCDLRFRSIIECVDDLGWFLSNCCGHISRNL

SEQ ID NO: 76848 - protein, 613 aa, Homo sapiens
  Payload ID: 15339
  Gene Symbol: SEC24A
  Gene Name: SEC24 homolog A, COPII coat complex component
  Uniprot ID: O95486
  ENSP ID: ENSP00000321749
MSQPGIPASGGAPASLQAQNGAALASGSPYTNGPVQNALLSSQESVSQGYNFQLPGSYPHPIPAKTLNPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKESVIGVSSEETLITCLEIAMR

SEQ ID NO: 76849 - protein, 1093 aa, Homo sapiens
  Payload ID: 15339
  Gene Symbol: SEC24A
  Gene Name: SEC24 homolog A, COPII coat complex component
  Uniprot ID: O95486
  ENSP ID: ENSP00000381823
MSQPGIPASGGAPASLQAQNGAALASGSPYTNGPVQNALLSSQESVSQGYNFQLPGSYPHPIPAKTLNPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKELVQDLLKTLPQMFTKTLETQSALGPALQAAFKLMSPTGGRMSVFQTQLPTLGVGALKPREEPNHRSSAKDIHMTPSTDFYKKLALDCSGQQVAVDLFLLSGQYSDLASLGCISRYSAGSVYYYPSYHHQHNPVQVQKLQKELQRYLTRKIGFEAVMRIRCTKGLSIHTFHGNFFVRSTDLLSLPNVNPDAGYAVQMSVEESLTDTQLVSFQSALLYTSSKGERRIRVHTLCLPVVSTLNDVFLGADVQAISGLLANMAVDRSMTASLSDARDALVNAVIDSLSAYRSSVLSNQQPGLMVPFSLRLFPLFVLALLKQKSFQTGTNARLDERIFAMCQVKNQPLVYLMLTTHPSLYRVDNLSDEGALNISDRTIPQPPILQLSVEKLSRDGAFLMDAGSVLMLWVGKNCTQNFLSQVLGVQNYASIPQPMTDLPELDTPESARIIAFISWLREQRPFFPILYVIRDESPMKANFLQNMIEDRTESALSYYEFLLHIQQQVNK

SEQ ID NO: 76850 - protein, 150 aa, Homo sapiens
  Payload ID: 15339
  Gene Symbol: SEC24A
  Gene Name: SEC24 homolog A, COPII coat complex component
  ENSP ID: ENSP00000424273
  MOD_RES (1)..(1): Any amino acid
XYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKEVRHIFLPDMFN

SEQ ID NO: 76851 - protein, 1268 aa, Homo sapiens
  Payload ID: 15340
  Gene Symbol: SEC24B
  Gene Name: SEC24 homolog B, COPII coat complex component
  Uniprot ID: O95487
  ENSP ID: ENSP00000265175
MSAPAGSSHPAASARIPPKFGGAAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVQYGEYVNNQASSAPTPLSSTSDDEEEEEEDEEAGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 76852 - protein, 1233 aa, Homo sapiens
  Payload ID: 15340
  Gene Symbol: SEC24B
  Gene Name: SEC24 homolog B, COPII coat complex component
  Uniprot ID: O95487
  ENSP ID: ENSP00000382051
MSAPAGSSHPAASARIPPKFGGAAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 76853 - protein, 1298 aa, Homo sapiens
  Payload ID: 15340
  Gene Symbol: SEC24B
  Gene Name: SEC24 homolog B, COPII coat complex component
  Uniprot ID: O95487
  ENSP ID: ENSP00000428564
MSAPAGSSHPAASARIPPKFGGAAVSGAAAPAGPGAGPAPHQQNETGFHHVAQASLELLDPSNLPASASQIAGSTGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVQYGEYVNNQASSAPTPLSSTSDDEEEEEEDEEAGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 76854 - protein, 1094 aa, Homo sapiens
  Payload ID: 15341
  Gene Symbol: SEC24C
  Gene Name: SEC24 homolog C, COPII coat complex component
  Uniprot ID: P53992
  ENSP ID: ENSP00000321845
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 76855 - protein, 1094 aa, Homo sapiens; identical to SEQ ID NO: 76854
  Payload ID: 15341
  Gene Symbol: SEC24C
  Gene Name: SEC24 homolog C, COPII coat complex component
  Uniprot ID: P53992
  ENSP ID: ENSP00000343405

SEQ ID NO: 76856 - protein, 1042 aa, Homo sapiens
  Payload ID: 15341
  Gene Symbol: SEC24C
  Gene Name: SEC24 homolog C, COPII coat complex component
  ENSP ID: ENSP00000437000
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLVRAGSQGEYGCGSILCETIGSQYS

SEQ ID NO: 76857 - protein, 183 aa, Homo sapiens
  Payload ID: 15341
  Gene Symbol: SEC24C
  Gene Name: SEC24 homolog C, COPII coat complex component
  ENSP ID: ENSP00000489340
QAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPQLSELPPQQKTRHRIDPDAIPSPIQVIEDDRNNRGTEPFVTGVRG

SEQ ID NO: 76858 - protein, 180 aa, Homo sapiens
  Payload ID: 15341
  Gene Symbol: SEC24C
  Gene Name: SEC24 homolog C, COPII coat complex component
  ENSP ID: ENSP00000489351
MNVNQSVPPVPPFGQPQPIYPGYHQSSYGGQSGSTAPAIPYGAYNGPVPGYQQTPPQGCLGLSHLGPHWPLWATSHLCFSPMALPRQVHRWLRSCLECRSAVLWPQPLLLQGWALAHQHRWLQPQEVSLTLVCMAPILRARLLPLARPKVILGSRLPSDLPHHRPPASHPQLQGVLGCLR

SEQ ID NO: 76859 - protein, 1032 aa, Homo sapiens
  Payload ID: 15342
  Gene Symbol: SEC24D
  Gene Name: SEC24 homolog D, COPII coat complex component
  Uniprot ID: O94855
  ENSP ID: ENSP00000280551
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPQQANSGPQMAGAQLSYPGGFPGGPAQMAGPPQPQKKLDPDSIPSPIQVIENDRASRGGQVYATNTRGQIPPLVTTDCMIQDQGNASPRFIRCTTYCFPCTSDMAKQAQIPLAAVIKPFATIPSNESPLYLVNHGESGPVRCNRCKAYMCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 76860 - protein, 393 aa, Homo sapiens
  Payload ID: 15342
  Gene Symbol: SEC24D
  Gene Name: SEC24 homolog D, COPII coat complex component
  ENSP ID: ENSP00000388324
MIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQFTCEK

SEQ ID NO: 76861 - protein, 67 aa, Homo sapiens
  Payload ID: 15342
  Gene Symbol: SEC24D
  Gene Name: SEC24 homolog D, COPII coat complex component
  ENSP ID: ENSP00000422717
MSQQGYVATPPYSQPQPGIGLSPPHYGHYGDPSHTASPTGRKLRSLKISFLPRFIQLISNQWGLELL

SEQ ID NO: 76862 - protein, 211 aa, Homo sapiens
  Payload ID: 15342
  Gene Symbol: SEC24D
  Gene Name: SEC24 homolog D, COPII coat complex component
  ENSP ID: ENSP00000424085
MSQQGYVATPPYSQPQPGIGLSPPHYGHYGDPSHTASPTGMMKPAGPLGATATRGMLPPGPPPPGPHQFGQNGAHATGHPPQRFRHGSSKPGTPWPSVSHIIADSSTTSTAFHFAAWISSSSTTTHHTQWSWCLTFASTNVQTRWALWASSSKCPVPAPTSSRPDLGCWISSAAGQLWSPDGRRTTVLPRRLPWRSCTDGWSATAPEEAGS

SEQ ID NO: 76863 - protein, 663 aa, Homo sapiens
  Payload ID: 15342
  Gene Symbol: SEC24D
  Gene Name: SEC24 homolog D, COPII coat complex component
  ENSP ID: ENSP00000425491
MCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 76864 - protein, 165 aa, Homo sapiens
  Payload ID: 15342
  Gene Symbol: SEC24D
  Gene Name: SEC24 homolog D, COPII coat complex component
  ENSP ID: ENSP00000426309
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQ

SEQ ID NO: 76865 - protein, 305 aa, Homo sapiens
  Payload ID: 15342
  Gene Symbol: SEC24D
  Gene Name: SEC24 homolog D, COPII coat complex component
  ENSP ID: ENSP00000427249
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYDHGKSGSSDVVRQKREDRRGKSHSTEIYINRNAVYPVQAWLLQARDPLALCQPHHCRLLHDLHSLPFCSLDLKFFHHHPPHSMVLVPHLCLYQCTDQMGSLGLLLQMPSTSPHLFQARPWVLDILRSRPTLVPRWQAHNCLTQEASLEVLHRWLVRHSPRRSWILTLSLAQSR

SEQ ID NO: 76866 - protein, 969 aa, Homo sapiens
  Payload ID: 15343
  Gene Symbol: SEC31A
  Gene Name: SEC31 homolog A, COPII coat complex component
  ENSP ID: ENSP00000264405
MVKLVLLSIVLLKVTVPKLSNDLLQLDFMPIHRGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHVRIAPTVTTWSNKTPTALPSHPPAASPSDTQGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76867 - protein, 1106 aa, Homo sapiens
  Payload ID: 15343
  Gene Symbol: SEC31A
  Gene Name: SEC31 homolog A, COPII coat complex component
  Uniprot ID: O94979
  ENSP ID: ENSP00000309070
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76868 - protein, 1181 aa, Homo sapiens
  Payload ID: 15343
  Gene Symbol: SEC31A
  Gene Name: SEC31 homolog A, COPII coat complex component
  Uniprot ID: O94979
  ENSP ID: ENSP00000337602
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76869 - protein, 1220 aa, Homo sapiens
  Payload ID: 15343
  Gene Symbol: SEC31A
  Gene Name: SEC31 homolog A, COPII coat complex component
  Uniprot ID: O94979
  ENSP ID: ENSP00000347329
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76870 - protein, 1220 aa, Homo sapiens; identical to SEQ ID NO: 76869
  Payload ID: 15343
  Gene Symbol: SEC31A
  Gene Name: SEC31 homolog A, COPII coat complex component
  Uniprot ID: O94979
  ENSP ID: ENSP00000378721

SEQ ID NO: 76871 - protein, 1220 aa, Homo sapiens; identical to SEQ ID NO: 76869
  Payload ID: 15343
  Gene Symbol: SEC31A
  Gene Name: SEC31 homolog A, COPII coat complex component
  Uniprot ID: O94979
  ENSP ID: ENSP00000400926

SEQ ID NO: 76872 - protein, 1200 aa, Homo sapiens
  Payload ID: 15343
  Gene Symbol: SEC31A
  Gene Name: SEC31 homolog A, COPII coat complex component
  Uniprot ID: O94979
  ENSP ID: ENSP00000408027
MLGESDERCTNAGSGCRRSSPGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76873 - protein, 92 aa, Homo sapiens
  Payload ID: 15343
  Gene Symbol: SEC31A
  Gene Name: SEC31 homolog A, COPII coat complex component
  ENSP ID: ENSP00000421001
MKLKEVDRTAMQAWSPAQNHPIYLATGTSAQQLDATFSTNASLEIFELDLSDPSLDMKSCATFSSSHRYHKLIWGPYKMDSKGDVSGVLIAD

SEQ ID NO: 76874 - protein, 1067 aa, Homo sapiens
  Payload ID: 15343
  Gene Symbol: SEC31A
  Gene Name: SEC31 homolog A, COPII coat complex component
  Uniprot ID: O94979
  ENSP ID: ENSP00000421464
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76875 - protein, 1251 aa, Homo sapiens
  Payload ID: 15343
  Gene Symbol: SEC31A
  Gene Name: SEC31 homolog A, COPII coat complex component
  ENSP ID: ENSP00000421633
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHVRIAPTVTTWSNKTPTALPSHPPAASPSDTQGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76876 - protein, 285 aa, Homo sapiens
  Payload ID: 15343
  Gene Symbol: SEC31A
  Gene Name: SEC31 homolog A, COPII coat complex component
  ENSP ID: ENSP00000422267
FGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGN

SEQ ID NO: 76877 - protein, 383 aa, Homo sapiens
  Payload ID: 15343
  Gene Symbol: SEC31A
  Gene Name: SEC31 homolog A, COPII coat complex component
  ENSP ID: ENSP00000422371
  MOD_RES (1)..(1): Any amino acid
XNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTENQSIQDQAPMLEGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76878 - protein, 81 aa, Homo sapiens
  Payload ID: 15343
  Gene Symbol: SEC31A
  Gene Name: SEC31 homolog A, COPII coat complex component
  ENSP ID: ENSP00000422563
MKLKEVDRTAMQAWSPAQNHPIYLATGTSAQQLDATFSTNASLEIFELDLSDPSLDMKSCATFSSSHRYHKLIWGPYKMDS

SEQ ID NO: 76879 - protein, 68 aa, Homo sapiens
  Payload ID: 15343
  Gene Symbol: SEC31A
  Gene Name: SEC31 homolog A, COPII coat complex component
  ENSP ID: ENSP00000422797
MKLKEVDRTAMQAWSPAQNHPIYLATGTSAQQLDATFSTNASLEIFELDLSDPSLDMKSCATFSSSHS

SEQ ID NO: 76880 - protein, 237 aa, Homo sapiens
  Payload ID: 15343
  Gene Symbol: SEC31A
  Gene Name: SEC31 homolog A, COPII coat complex component
  ENSP ID: ENSP00000424336
  MOD_RES (1)..(1): Any amino acid
XAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCGNVEKLVACWTKAQDGSHPLSLQDLIEKVVILRKAVQLTQAMDTSTVGVLLAA

SEQ ID NO: 76881 - protein, 1166 aa, Homo sapiens
  Payload ID: 15343
  Gene Symbol: SEC31A
  Gene Name: SEC31 homolog A, COPII coat complex component
  Uniprot ID: O94979
  ENSP ID: ENSP00000424451
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76882 - protein, 1205 aa, Homo sapiens
  Payload ID: 15343
  Gene Symbol: SEC31A
  Gene Name: SEC31 homolog A, COPII coat complex component
  Uniprot ID: O94979
  ENSP ID: ENSP00000424635
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 76883 - protein, 235 aa, Homo sapiens
  Payload ID: 15343
  Gene Symbol: SEC31A
  Gene Name: SEC31 homolog A, COPII coat complex component
  ENSP ID: ENSP00000425056
TQDPAAEGPRQQDEVKGSRSYSHAGMEPCPESPHLPSNRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARYRA

SEQ ID NO: 76884 - protein, 26 aa, Homo sapiens
  Payload ID: 15343
  Gene Symbol: SEC31A
  Gene Name: SEC31 homolog A, COPII coat complex component
  ENSP ID: ENSP00000425064
MKLKEVDRTAMQAWSPAQNHPIYLAT

SEQ ID NO: 76885 - protein, 66 aa, Homo sapiens
  Payload ID: 15343
  Gene Symbol: SEC31A
  Gene Name: SEC31 homolog A, COPII coat complex component
  ENSP ID: ENSP00000425095
MKLKEVDRTAMQAWSPAQNHPIYLATGTSAQQLDATFSTNASLEIFELDLSDPSLDMKSCATFSSS

SEQ ID NO: 76886 - protein, 219 aa, Homo sapiens
  Payload ID: 15343
  Gene Symbol: SEC31A
  Gene Name: SEC31 homolog A, COPII coat complex component
  ENSP ID: ENSP00000425140
  MOD_RES (1)..(1): Any amino acid
XQMPRVQTQQYYPHVRIAPTVTTWSNKTPTALPSHPPAASPSDTQGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTT

SEQ ID NO: 76887 - protein, 166 aa, Homo sapiens
  Payload ID: 15343
  Gene Symbol: SEC31A
  Gene Name: SEC31 homolog A, COPII coat complex component
  ENSP ID: ENSP00000425555
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQ

SEQ ID NO: 76888 - protein, 877 aa, Homo sapiens
  Payload ID: 15343
  Gene Symbol: SEC31A
  Gene Name: SEC31 homolog A, COPII coat complex component
  ENSP ID: ENSP00000425999
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRK

SEQ ID NO: 76889 - protein, 443 aa, Homo sapiens
  Payload ID: 15343
  Gene Symbol: SEC31A
  Gene Name: SEC31 homolog A, COPII coat complex component
  ENSP ID: ENSP00000426562
  MOD_RES (1)..(1): Any amino acid
XFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRV

SEQ ID NO: 76890 - protein, 1106 aa, Homo sapiens; identical to SEQ ID NO: 76867
  Payload ID: 15343
  Gene Symbol: SEC31A
  Gene Name: SEC31 homolog A, COPII coat complex component
  Uniprot ID: O94979
  ENSP ID: ENSP00000426569

SEQ ID NO: 76891 - protein, 1067 aa, Homo sapiens; identical to SEQ ID NO: 76874
  Payload ID: 15343
  Gene Symbol: SEC31A
  Gene Name: SEC31 homolog A, COPII coat complex component
  Uniprot ID: O94979
  ENSP ID: ENSP00000426886

SEQ ID NO: 76892 - protein, 181 aa, Homo sapiens
  Payload ID: 15343
  Gene Symbol: SEC31A
  Gene Name: SEC31 homolog A, COPII coat complex component
  ENSP ID: ENSP00000426943
  MOD_RES (1)..(1): Any amino acid
XPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPLSPTITSGLHNIARSIETRNYSEGLTMHTHIVSTSNFSETSAFMPVLKVVLTQANKLGV

SEQ ID NO: 76893 - protein, 164 aa, Homo sapiens
  Payload ID: 15343
  Gene Symbol: SEC31A
  Gene Name: SEC31 homolog A, COPII coat complex component
  ENSP ID: ENSP00000426950
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAK

SEQ ID NO: 76894 - protein, 65 aa, Homo sapiens
  Payload ID: 15343
  Gene Symbol: SEC31A
  Gene Name: SEC31 homolog A, COPII coat complex component
  ENSP ID: ENSP00000475765
MKLKEVDRTAMQAWSPAQNHPIYLATGTSAQQLDATFSTNASLEIFELDLSDPSLDMKSCATFSS

SEQ ID NO: 76895 - protein, 11 aa, Homo sapiens
  Payload ID: 15343
  Gene Symbol: SEC31A
  Gene Name: SEC31 homolog A, COPII coat complex component
  ENSP ID: ENSP00000476156
MKLKEVDRTAM

SEQ ID NO: 76896 - protein, 1179 aa, Homo sapiens
  Payload ID: 15344
  Gene Symbol: SEC31B
  Gene Name: SEC31 homolog B, COPII coat complex component
  Uniprot ID: Q9NQW1
  ENSP ID: ENSP00000359370
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRMHCSGLAWHPDIATQLVLCSEDDRLPVIQLWDLRFASSPLKVLESHSRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCDMLGTRMEQEGSRALTSEARLCYVCSGSVERLVECWAKCHQALSPMALQDLMEKVMVLNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQLQHLPPEKMERKELPPEHQSLKSSFEALLQRCSLSATDLKTKRKLEEAAQRLEYLYEKLCEGTLSPHVVAGLHEVARCVDAGSFEQGLAVHAQVAGCSSFSEVSSFMPILKAVLIIAHKLLV

SEQ ID NO: 76897 - protein, 85 aa, Homo sapiens
  Payload ID: 15344
  Gene Symbol: SEC31B
  Gene Name: SEC31 homolog B, COPII coat complex component
  ENSP ID: ENSP00000432260
MKLKELERPAVQAWSPASQYPLYLATGTSAQQLDSSFSTNGTLEIFEVDFRDPSLDLKHRGVLSALSRATSWLQGPAILKSSFGI

SEQ ID NO: 76898 - protein, 349 aa, Homo sapiens
  Payload ID: 15344
  Gene Symbol: SEC31B
  Gene Name: SEC31 homolog B, COPII coat complex component
  ENSP ID: ENSP00000435359
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRMHCSGLAWHPDIATQLVLCSEDDRLPVIQLWDLRFASSPLKVLESHSRGILSVSWSQADAELLLTSAKDSQILCRNLGSSEVVYKLPTQSSWCFDVQWCPRDPSVFSAASFNGWISLYSVMGRSWEVQHMRQADKV

SEQ ID NO: 76899 - protein, 85 aa, Homo sapiens; identical to SEQ ID NO: 76897
  Payload ID: 15344
  Gene Symbol: SEC31B
  Gene Name: SEC31 homolog B, COPII coat complex component
  ENSP ID: ENSP00000473769

SEQ ID NO: 76900 - protein, 85 aa, Homo sapiens; identical to SEQ ID NO: 76897
  Payload ID: 15344
  Gene Symbol: SEC31B
  Gene Name: SEC31 homolog B, COPII coat complex component
  ENSP ID: ENSP00000473995

SEQ ID NO: 76901 - protein, 348 aa, Homo sapiens
  Payload ID: 15344
  Gene Symbol: SEC31B
  Gene Name: SEC31 homolog B, COPII coat complex component
  Uniprot ID: Q9NQW1
  ENSP ID: ENSP00000474124
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQPPEDIKALSWNRQAQHILSSAHPSGKAVVWDLRKNEPIIKVSDHSNRMHCSGLAWHPDIATQLVLCSEDDRLPVIQLWDLRFASSPLKVLESHSRGILSVSWSQADAELLLTSAKDSQILCRNLGSSEVVYKLPTQSSWCFDVQWCPRDPSVFSAASFNGWISLYSVMGRSWEVQHMRQADKV

SEQ ID NO: 76902 - protein, 476 aa, Homo sapiens
  Payload ID: 15345
  Gene Symbol: SEC61A1
  Gene Name: Sec61 translocon alpha 1 subunit
  Uniprot ID: P61619
  ENSP ID: ENSP00000243253
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 76903 - protein, 356 aa, Homo sapiens
  Payload ID: 15345
  Gene Symbol: SEC61A1
  Gene Name: Sec61 translocon alpha 1 subunit
  Uniprot ID: P61619
  ENSP ID: ENSP00000411445
MIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 76904 - protein, 482 aa, Homo sapiens
  Payload ID: 15345
  Gene Symbol: SEC61A1
  Gene Name: Sec61 translocon alpha 1 subunit
  ENSP ID: ENSP00000418493
MTQTARVLVKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 76905 - protein, 101 aa, Homo sapiens
  Payload ID: 15345
  Gene Symbol: SEC61A1
  Gene Name: Sec61 translocon alpha 1 subunit
  ENSP ID: ENSP00000419172
MSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQ

SEQ ID NO: 76906 - protein, 476 aa, Homo sapiens
  Payload ID: 15346
  Gene Symbol: SEC61A2
  Gene Name: Sec61 translocon alpha 2 subunit
  Uniprot ID: Q9H9S3
  ENSP ID: ENSP00000298428
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 76907 - protein, 437 aa, Homo sapiens
  Payload ID: 15346
  Gene Symbol: SEC61A2
  Gene Name: Sec61 translocon alpha 2 subunit
  Uniprot ID: Q9H9S3
  ENSP ID: ENSP00000302048
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRPKVKLRRWKGEGRHFTKRILFY

SEQ ID NO: 76908 - protein, 168 aa, Homo sapiens
  Payload ID: 15346
  Gene Symbol: SEC61A2
  Gene Name: Sec61 translocon alpha 2 subunit
  ENSP ID: ENSP00000368302
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQALLTLKICGYTEEL

SEQ ID NO: 76909 - protein, 410 aa, Homo sapiens
  Payload ID: 15346
  Gene Symbol: SEC61A2
  Gene Name: Sec61 translocon alpha 2 subunit
  ENSP ID: ENSP00000368306
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQDVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 76910 - protein, 454 aa, Homo sapiens
  Payload ID: 15346
  Gene Symbol: SEC61A2
  Gene Name: Sec61 translocon alpha 2 subunit
  Uniprot ID: Q9H9S3
  ENSP ID: ENSP00000368319
MGIKFLEVIKPFCAVLPEIQKPERKIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 76911 - protein, 159 aa, Homo sapiens
  Payload ID: 15346
  Gene Symbol: SEC61A2
  Gene Name: Sec61 translocon alpha 2 subunit
  ENSP ID: ENSP00000368339
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQDQHSP

SEQ ID NO: 76912 - protein, 145 aa, Homo sapiens
  Payload ID: 15346
  Gene Symbol: SEC61A2
  Gene Name: Sec61 translocon alpha 2 subunit
  ENSP ID: ENSP00000393214
  MOD_RES (1)..(1): Any amino acid
XSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQGFRVDLPIKSARYRGQYSSYPIKLFYTSNIPIILQSALVSNLYVI

SEQ ID NO: 76913 - protein, 94 aa, Homo sapiens
  Payload ID: 15346
  Gene Symbol: SEC61A2
  Gene Name: Sec61 translocon alpha 2 subunit
  ENSP ID: ENSP00000401731
  MOD_RES (1)..(1): Any amino acid
XFREKVLWTAITLFIFLVCCQIPLFGIMSSDSADPFYWMRVILASNRGTLMELGISPIVTSGLIMQLLAGAKIIEVGDTPKDRALFNGAQKREH

SEQ ID NO: 76914 - protein, 228 aa, Homo sapiens
  Payload ID: 15346
  Gene Symbol: SEC61A2
  Gene Name: Sec61 translocon alpha 2 subunit
  ENSP ID: ENSP00000402124
  MOD_RES (1)..(1): Any amino acid
XGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 76915 - protein, 189 aa, Homo sapiens
  Payload ID: 15346
  Gene Symbol: SEC61A2
  Gene Name: Sec61 translocon alpha 2 subunit
  ENSP ID: ENSP00000404959
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKRTEFEGAVIALFHLLATRTDKVRALREAFYRQNLPNLMNLIATVFVFAVVIYFQGFRVDLPIKSARYRGQYS

SEQ ID NO: 76916 - protein, 162 aa, Homo sapiens
  Payload ID: 15346
  Gene Symbol: SEC61A2
  Gene Name: Sec61 translocon alpha 2 subunit
  ENSP ID: ENSP00000436294
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQVLSLRVQS

SEQ ID NO: 76917 - protein, 418 aa, Homo sapiens
  Payload ID: 15346
  Gene Symbol: SEC61A2
  Gene Name: Sec61 translocon alpha 2 subunit
  ENSP ID: ENSP00000436749
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNSARA

SEQ ID NO: 76918 - protein, 96 aa, Homo sapiens
  Payload ID: 15347
  Gene Symbol: SEC61B
  Gene Name: Sec61 translocon beta subunit
  Uniprot ID: P60468
  ENSP ID: ENSP00000223641
MPGPTPSGTNVGSSGRSPSKAVAARAAGSTVRQRKNASCGTRSAGRTTSAGTGGMWRFYTEDSPGLKVGPVPVLVMSLLFIASVFMLHIWGKYTRS

SEQ ID NO: 76919 - protein, 42 aa, Homo sapiens
  Payload ID: 15347
  Gene Symbol: SEC61B
  Gene Name: Sec61 translocon beta subunit
  ENSP ID: ENSP00000474122
MWRFYTEDSPGLKVGPVPVLVMSLLFIASVFMLHIWGKYTRS

SEQ ID NO: 76920 - protein, 68 aa, Homo sapiens
  Payload ID: 15348
  Gene Symbol: SEC61G
  Gene Name: Sec61 translocon gamma subunit
  Uniprot ID: P60059
  ENSP ID: ENSP00000341538
MDQVMQFVEPSRQFVKDSIRLVKRCTKPDRKEFQKIAMATAIGFAIMGFIGFFVKLIHIPINNIIVGG

SEQ ID NO: 76921 - protein, 68 aa, Homo sapiens; identical to SEQ ID NO: 76920
  Payload ID: 15348
  Gene Symbol: SEC61G
  Gene Name: Sec61 translocon gamma subunit
  Uniprot ID: P60059
  ENSP ID: ENSP00000378906

SEQ ID NO: 76922 - protein, 68 aa, Homo sapiens; identical to SEQ ID NO: 76920
  Payload ID: 15348
  Gene Symbol: SEC61G
  Gene Name: Sec61 translocon gamma subunit
  Uniprot ID: P60059
  ENSP ID: ENSP00000388337

SEQ ID NO: 76923 - protein, 68 aa, Homo sapiens; identical to SEQ ID NO: 76920
  Payload ID: 15348
  Gene Symbol: SEC61G
  Gene Name: Sec61 translocon gamma subunit
  Uniprot ID: P60059
  ENSP ID: ENSP00000409884

SEQ ID NO: 76924 - protein, 399 aa, Homo sapiens
  Payload ID: 15349
  Gene Symbol: SEC62
  Gene Name: SEC62 homolog, preprotein translocation factor
  Uniprot ID: Q99442
  ENSP ID: ENSP00000337688
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 76925 - protein, 101 aa, Homo sapiens
  Payload ID: 15349
  Gene Symbol: SEC62
  Gene Name: SEC62 homolog, preprotein translocation factor
  ENSP ID: ENSP00000418342
MAERRRHKKRIQEVGEPSKEEKAVAKYLRFNCPTKSTNMMGHRVDYFIASKAVDCLLDSKWAKAKKGEEALFTTRESVVDYCNSLYLYGECNAIPVFPKGF

SEQ ID NO: 76926 - protein, 85 aa, Homo sapiens
  Payload ID: 15349
  Gene Symbol: SEC62
  Gene Name: SEC62 homolog, preprotein translocation factor
  ENSP ID: ENSP00000419319
MAERRRHKKRIQEVGEPSKEEKAVAKYLRFNCPTKSTNMMGHRVDYFIASKAVDCLLDSKWAKAKKGEEALFTTRESVVDYCNRS

SEQ ID NO: 76927 - protein, 47 aa, Homo sapiens
  Payload ID: 15349
  Gene Symbol: SEC62
  Gene Name: SEC62 homolog, preprotein translocation factor
  ENSP ID: ENSP00000420304
MAERRRHKKRIQYNFRFSCPIEVSSKRTVVTFPSWTHYWSLKTRRSW

SEQ ID NO: 76928 - protein, 399 aa, Homo sapiens; identical to SEQ ID NO: 76924
  Payload ID: 15349
  Gene Symbol: SEC62
  Gene Name: SEC62 homolog, preprotein translocation factor
  Uniprot ID: Q99442
  ENSP ID: ENSP00000420331

SEQ ID NO: 76929 - protein, 760 aa, Homo sapiens
  Payload ID: 15350
  Gene Symbol: SEC63
  Gene Name: SEC63 homolog, protein translocation regulator
  Uniprot ID: Q9UGP8
  ENSP ID: ENSP00000357998
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 76930 - protein, 161 aa, Homo sapiens
  Payload ID: 15350
  Gene Symbol: SEC63
  Gene Name: SEC63 homolog, protein translocation regulator
  ENSP ID: ENSP00000403144
MWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIR

SEQ ID NO: 76931 - protein, 80 aa, Homo sapiens
  Payload ID: 15350
  Gene Symbol: SEC63
  Gene Name: SEC63 homolog, protein translocation regulator
  ENSP ID: ENSP00000410968
MAGQQFQYDDSGNTFFYFLTSFVGLIVIPATYYLWPRDQNAAGRVSFTQAGLELASSHPPASAPRVAGLTDLSHCVRMDF

SEQ ID NO: 76932 - protein, 414 aa, Homo sapiens
  Payload ID: 15351
  Gene Symbol: SCRN1
  Gene Name: secernin 1
  Uniprot ID: Q12765
  ENSP ID: ENSP00000242059
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 76933 - protein, 414 aa, Homo sapiens; identical to SEQ ID NO: 76932
  Payload ID: 15351
  Gene Symbol: SCRN1
  Gene Name: secernin 1
  Uniprot ID: Q12765
  ENSP ID: ENSP00000386872

SEQ ID NO: 76934 - protein, 140 aa, Homo sapiens
  Payload ID: 15351
  Gene Symbol: SCRN1
  Gene Name: secernin 1
  ENSP ID: ENSP00000387052
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRNGQGELDIPVRRSWAPRERFSYKTRN

SEQ ID NO: 76935 - protein, 434 aa, Homo sapiens
  Payload ID: 15351
  Gene Symbol: SCRN1
  Gene Name: secernin 1
  Uniprot ID: Q12765
  ENSP ID: ENSP00000388942
MVQDGTFKTRDSTWTCESTRMAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 76936 - protein, 141 aa, Homo sapiens
  Payload ID: 15351
  Gene Symbol: SCRN1
  Gene Name: secernin 1
  ENSP ID: ENSP00000406289
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGG

SEQ ID NO: 76937 - protein, 414 aa, Homo sapiens; identical to SEQ ID NO: 76932
  Payload ID: 15351
  Gene Symbol: SCRN1
  Gene Name: secernin 1
  Uniprot ID: Q12765
  ENSP ID: ENSP00000409068

SEQ ID NO: 76938 - protein, 245 aa, Homo sapiens
  Payload ID: 15351
  Gene Symbol: SCRN1
  Gene Name: secernin 1
  ENSP ID: ENSP00000413184
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQ

SEQ ID NO: 76939 - protein, 346 aa, Homo sapiens
  Payload ID: 15351
  Gene Symbol: SCRN1
  Gene Name: secernin 1
  Uniprot ID: Q12765
  ENSP ID: ENSP00000414245
MISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 76940 - protein, 140 aa, Homo sapiens; identical to SEQ ID NO: 76934
  Payload ID: 15351
  Gene Symbol: SCRN1
  Gene Name: secernin 1
  ENSP ID: ENSP00000486034

SEQ ID NO: 76941 - protein, 425 aa, Homo sapiens
  Payload ID: 15352
  Gene Symbol: SCRN2
  Gene Name: secernin 2
  Uniprot ID: Q96FV2
  ENSP ID: ENSP00000290216
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGMGVAQAPQVLSPTFGAQDPVRTLPRFQTQVDRRHTLYRGHQAALGLMERDQDRGQQLQQKQQDLEQEGLEATQGLLAGEWAPPLWELGSLFQAFVKRESQAYA

SEQ ID NO: 76942 - protein, 378 aa, Homo sapiens
  Payload ID: 15352
  Gene Symbol: SCRN2
  Gene Name: secernin 2
  Uniprot ID: Q96FV2
  ENSP ID: ENSP00000383935
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGMGVAQAPQVLSPTFGAQDPVRTLPRFQTQVDRRHTLYRGHQAALGLMERDQVSPRE

SEQ ID NO: 76943 - protein, 97 aa, Homo sapiens
  Payload ID: 15352
  Gene Symbol: SCRN2
  Gene Name: secernin 2
  ENSP ID: ENSP00000462318
MASSSPDSPCSCDCFVSVPPASAIPAVIFAKNSDRPRDEVQEVVFVPAGTHTPGSRLQAGFGTEQLCPGGLACDHRVTGALWAGGQLPGGCCAILLP

SEQ ID NO: 76944 - protein, 127 aa, Homo sapiens
  Payload ID: 15352
  Gene Symbol: SCRN2
  Gene Name: secernin 2
  ENSP ID: ENSP00000462845
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRPFHGTLKA

SEQ ID NO: 76945 - protein, 433 aa, Homo sapiens
  Payload ID: 15352
  Gene Symbol: SCRN2
  Gene Name: secernin 2
  ENSP ID: ENSP00000463411
MERPASPQMASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGMGVAQAPQVLSPTFGAQDPVRTLPRFQTQVDRRHTLYRGHQAALGLMERDQDRGQQLQQKQQDLEQEGLEATQGLLAGEWAPPLWELGSLFQAFVKRESQAYA

SEQ ID NO: 76946 - protein, 269 aa, Homo sapiens
  Payload ID: 15352
  Gene Symbol: SCRN2
  Gene Name: secernin 2
  ENSP ID: ENSP00000463809
  MOD_RES (1)..(1): Any amino acid
XTGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGMGVAQAPQVLSPTFGAQDPVRTLPRFQTQDRGQQLQQKQQDLEQEGLEATQGLLAGEWAPPLWELGSLFQAFVKRESQAYA

SEQ ID NO: 76947 - protein, 180 aa, Homo sapiens
  Payload ID: 15352
  Gene Symbol: SCRN2
  Gene Name: secernin 2
  ENSP ID: ENSP00000464093
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWA

SEQ ID NO: 76948 - protein, 97 aa, Homo sapiens; identical to SEQ ID NO: 76943
  Payload ID: 15352
  Gene Symbol: SCRN2
  Gene Name: secernin 2
  ENSP ID: ENSP00000464105

SEQ ID NO: 76949 - protein, 271 aa, Homo sapiens
  Payload ID: 15352
  Gene Symbol: SCRN2
  Gene Name: secernin 2
  ENSP ID: ENSP00000464246
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQASPSTPWQGASRQR

SEQ ID NO: 76950 - protein, 424 aa, Homo sapiens
  Payload ID: 15353
  Gene Symbol: SCRN3
  Gene Name: secernin 3
  Uniprot ID: Q0VDG4
  ENSP ID: ENSP00000272732
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 76951 - protein, 417 aa, Homo sapiens
  Payload ID: 15353
  Gene Symbol: SCRN3
  Gene Name: secernin 3
  Uniprot ID: Q0VDG4
  ENSP ID: ENSP00000387142
MPPLATPPSVHLSLRVAGRPDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSVKVSS

SEQ ID NO: 76952 - protein, 10 aa, Homo sapiens
  Payload ID: 15353
  Gene Symbol: SCRN3
  Gene Name: secernin 3
  ENSP ID: ENSP00000394024
MEPFSCDTFV

SEQ ID NO: 76953 - protein, 216 aa, Homo sapiens
  Payload ID: 15353
  Gene Symbol: SCRN3
  Gene Name: secernin 3
  ENSP ID: ENSP00000396884
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGK

SEQ ID NO: 76954 - protein, 117 aa, Homo sapiens
  Payload ID: 15353
  Gene Symbol: SCRN3
  Gene Name: secernin 3
  ENSP ID: ENSP00000400421
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRGSS

SEQ ID NO: 76955 - protein, 113 aa, Homo sapiens
  Payload ID: 15353
  Gene Symbol: SCRN3
  Gene Name: secernin 3
  ENSP ID: ENSP00000402086
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLV

SEQ ID NO: 76956 - protein, 135 aa, Homo sapiens
  Payload ID: 15353
  Gene Symbol: SCRN3
  Gene Name: secernin 3
  ENSP ID: ENSP00000408376
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLE

SEQ ID NO: 76957 - protein, 209 aa, Homo sapiens
  Payload ID: 15353
  Gene Symbol: SCRN3
  Gene Name: secernin 3
  ENSP ID: ENSP00000446727
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKR

SEQ ID NO: 76958 - protein, 117 aa, Homo sapiens; identical to SEQ ID NO: 76954
  Payload ID: 15353
  Gene Symbol: SCRN3
  Gene Name: secernin 3
  ENSP ID: ENSP00000447307

SEQ ID NO: 76959 - protein, 429 aa, Homo sapiens
  Payload ID: 15353
  Gene Symbol: SCRN3
  Gene Name: secernin 3
  ENSP ID: ENSP00000479847
MEPFSCDTFVALPPATVDNRIIFGKNSDRLYDEVQEVVYFPAVVHDNLGERLKCTYIEIDQVPETYAVVLSRPAWLWGAEMGANEHGVCIGNEAVWGREEVCDEEALLGMDLVRLGLERADTAEKALNVIVDLLEKYGQGGNCTEGRMVFSYHNSFLIADRNEAWILETAGKYWAAEKVQEGVRNISNQLSITTKIAREHPDMRNYAKRKGWWDGKKEFDFAAAYSYLDTAKMMTSSGRYCEGYKLLNKHKGNITFETMMEILRDKPSGINMEGEFLTTASMVSILPQDSSLPCIHFFTGTPDPERSVFKPFIFVPHISQLLDTSSPTFELEDLVKKKSHFKPDRRHPLYQKHQQALEVVNNNEEKAKIMLDNMRKLEKELFREMESILQNKHLDVEKIVNLFPQCTKDEIQIYQSNLSKLVLSDHMVS

SEQ ID NO: 76960 - protein, 781 aa, Homo sapiens
  Payload ID: 15354
  Gene Symbol: SECISBP2
  Gene Name: SECIS binding protein 2
  Uniprot ID: Q96T21
  ENSP ID: ENSP00000364959
MVRVLRSMCLPQLCSHILSVCSGTTSDRNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 76961 - protein, 854 aa, Homo sapiens
  Payload ID: 15354
  Gene Symbol: SECISBP2
  Gene Name: SECIS binding protein 2
  Uniprot ID: Q96T21
  ENSP ID: ENSP00000364965
MASEGPREPESEGIKLSADVKPFVPRFAGLNVAWLESSEACVFPSSAATYYPFVQEPPVTEQKIYTEDMAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 76962 - protein, 60 aa, Homo sapiens
  Payload ID: 15354
  Gene Symbol: SECISBP2
  Gene Name: SECIS binding protein 2
  ENSP ID: ENSP00000411573
MPLPILLHVQEQILKMLVYHLLKLYLRILPTTKKNTLFILPKSLKHHKVVTLNKMKPQER

SEQ ID NO: 76963 - protein, 275 aa, Homo sapiens
  Payload ID: 15354
  Gene Symbol: SECISBP2
  Gene Name: SECIS binding protein 2
  ENSP ID: ENSP00000414288
GTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVS

SEQ ID NO: 76964 - protein, 786 aa, Homo sapiens
  Payload ID: 15354
  Gene Symbol: SECISBP2
  Gene Name: SECIS binding protein 2
  Uniprot ID: Q96T21
  ENSP ID: ENSP00000436650
MAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 76965 - protein, 1056 aa, Homo sapiens
  Payload ID: 15355
  Gene Symbol: SECISBP2L
  Gene Name: SECIS binding protein 2-like
  Uniprot ID: Q93073
  ENSP ID: ENSP00000261847
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGPDSRSKIVLLVDASQQTDFPSDIANKSLSETTATMLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEDTGLSMPSDTSLSPASQNSPYCMTPVSQGSPASSGIGSPMASSTITKIHSKRFREYCNQVLCKEIDECVTLLLQELVSFQERIYQKDPVRAKARRRLVMGLREVTKHMKLNKIKCVIISPNCEKIQSKGGLDEALYNVIAMAREQEIPFVFALGRKALGRCVNKLVPVSVVGIFNYFGAESLFNKLVELTEEARKAYKDMVAAMEQEQAEEALKNVKKVPHHMGHSRNPSAASAISFCSVISEPISEVNEKEYETNWRNMVETSDGLEASENEKEVSCKHSTSEKPSKLPFDTPPIGKQPSLVATGSTTSATSAGKSTASDKEEVKPDDLEWASQQSTETGSLDGSCRDLLNSSITSTTSTLVPGMLEEEEDEDEEEEEDYTHEPISVEVQLNSRIESWVSETQRTMETLQLGKTLNGSEEDNVEQSGEEEAEAPEVLEPGMDSEAWTADQQASPGQQKSSNCSSLNKEHSDSNYTTQTT

SEQ ID NO: 76966 - protein, 630 aa, Homo sapiens
  Payload ID: 15355
  Gene Symbol: SECISBP2L
  Gene Name: SECIS binding protein 2-like
  ENSP ID: ENSP00000370314
MLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQVGFRCRGHSTSSERRQNLQKRPDNKHLSSSQSHRSDPNSESLYFEDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEDTGLSMPSDTSLSPASQNSPYCMTPVSQGSPASSGIGSPMASSTITKIHSKRFREYCNQVLCKEIDECVTLLLQELVSFQERIYQKDPVRAKARRRLVMGLREVTKHMKLNKIKCVIISPNCEKIQSKGGLDEALYNVIAMAREQEIPFVFALGRKALGRCVNKLVPVSVVGIFNYFGAESLFNKLVELTEEARKAYKDMVAAMEQEQAEEALKNVKKVPHHMGHSRNPSAASAISFCSVISEPISE

SEQ ID NO: 76967 - protein, 312 aa, Homo sapiens
  Payload ID: 15355
  Gene Symbol: SECISBP2L
  Gene Name: SECIS binding protein 2-like
  ENSP ID: ENSP00000452987
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGALRNPDSGTMNHVESSMCAGGVNWSNVTCQATQKKPWMEKNQTFSRGGRQTEQRNNSQDEDGFQELNENGNAKDENIQQKLSSKVLDDLPENSPINIVQTPIPITTSV

SEQ ID NO: 76968 - protein, 1101 aa, Homo sapiens
  Payload ID: 15355
  Gene Symbol: SECISBP2L
  Gene Name: SECIS binding protein 2-like
  Uniprot ID: Q93073
  ENSP ID: ENSP00000453854
MDRAPTEQNVKLSAEVEPFIPQKKSPDTFMIPMALPNDNGSVSGVEPTPIPSYLITCYPFVQENQSNRQFPLYNNDIRWQQPNPNPTGPYFAYPIISAQPPVSTEYTYYQLMPAPCAQVMGFYHPFPTPYSNTFQAANTVNAITTECTERPSQLGQVFPLSSHRSRNSNRGSVVPKQQLLQQHIKSKRPLVKNVATQKETNAAGPDSRSKIVLLVDASQQTDFPSDIANKSLSETTATMLWKSKGRRRRASHPTAESSSEQGASEADIDSDSGYCSPKHSNNQPAAGALRNPDSGTMNHVESSMCAGGVNWSNVTCQATQKKPWMEKNQTFSRGGRQTEQRNNSQVGFRCRGHSTSSERRQNLQKRPDNKHLSSSQSHRSDPNSESLYFEDEDGFQELNENGNAKDENIQQKLSSKVLDDLPENSPINIVQTPIPITTSVPKRAKSQKKKALAAALATAQEYSEISMEQKKLQEALSKAAGKKNKTPVQLDLGDMLAALEKQQQAMKARQITNTRPLSYTVVTAASFHTKDSTNRKPLTKSQPCLTSFNSVDIASSKAKKGKEKEIAKLKRPTALKKVILKEREEKKGRLTVDHNLLGSEEPTEMHLDFIDDLPQEIVSQEDTGLSMPSDTSLSPASQNSPYCMTPVSQGSPASSGIGSPMASSTITKIHSKRFREYCNQVLCKEIDECVTLLLQELVSFQERIYQKDPVRAKARRRLVMGLREVTKHMKLNKIKCVIISPNCEKIQSKGGLDEALYNVIAMAREQEIPFVFALGRKALGRCVNKLVPVSVVGIFNYFGAESLFNKLVELTEEARKAYKDMVAAMEQEQAEEALKNVKKVPHHMGHSRNPSAASAISFCSVISEPISEVNEKEYETNWRNMVETSDGLEASENEKEVSCKHSTSEKPSKLPFDTPPIGKQPSLVATGSTTSATSAGKSTASDKEEVKPDDLEWASQQSTETGSLDGSCRDLLNSSITSTTSTLVPGMLEEEEDEDEEEEEDYTHEPISVEVQLNSRIESWVSETQRTMETLQLGKTLNGSEEDNVEQSGEEEAEAPEVLEPGMDSEAWTADQQASPGQQKSSNCSSLNKEHSDSNYTTQTT

SEQ ID NO: 76969 - protein, 95 aa, Homo sapiens
  Payload ID: 15355
  Gene Symbol: SECISBP2L
  Gene Name: SECIS binding protein 2-like
  ENSP ID: ENSP00000454144
  MOD_RES (1)..(1): Any amino acid
XKNVKKVPHHMGHSRNPSAASAISFCSVISEPISEVNEKEYETNWRNMVETSDGLEASENEKEVSCKHSTSEKPSKLPFDTPPIEILQEFMTPHK

SEQ ID NO: 76970 - protein, 49 aa, Homo sapiens
  Payload ID: 15356
  Gene Symbol: SCGN
  Gene Name: secretagogin, EF-hand calcium binding protein
  ENSP ID: ENSP00000333933
MDSSREPTLGRLDAAGFWQVWQRFDADGHGHESKFAQGETAVYDYPRCL

SEQ ID NO: 76971 - protein, 276 aa, Homo sapiens
  Payload ID: 15356
  Gene Symbol: SCGN
  Gene Name: secretagogin, EF-hand calcium binding protein
  Uniprot ID: O76038
  ENSP ID: ENSP00000367197
MDSSREPTLGRLDAAGFWQVWQRFDADEKGYIEEKELDAFFLHMLMKLGTDDTVMKANLHKVKQQFMTTQDASKDGRIRMKELAGMFLSEDENFLLLFRRENPLDSSVEFMQIWRKYDADSSGFISAAELRNFLRDLFLHHKKAISEAKLEEYTGTMMKIFDRNKDGRLDLNDLARILALQENFLLQFKMDACSTEERKRDFEKIFAYYDVSKTGALEGPEVDGFVKDMMELVQPSISGVDLDKFREILLRHCDVNKDGKIQKSELALCLGLKINP

SEQ ID NO: 76972 - protein, 49 aa, Homo sapiens; identical to SEQ ID NO: 76970
  Payload ID: 15356
  Gene Symbol: SCGN
  Gene Name: secretagogin, EF-hand calcium binding protein
  ENSP ID: ENSP00000484392

SEQ ID NO: 76973 - protein, 248 aa, Homo sapiens
  Payload ID: 15357
  Gene Symbol: SECTM1
  Gene Name: secreted and transmembrane 1
  Uniprot ID: Q8WVN6
  ENSP ID: ENSP00000269389
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRREKKFFLLEPQMKVAALRAGAQQGLSRASAELWTPDSEPTPRPLALVFKPSPLGALELLSPQPLFPYAADP

SEQ ID NO: 76974 - protein, 85 aa, Homo sapiens
  Payload ID: 15357
  Gene Symbol: SECTM1
  Gene Name: secreted and transmembrane 1
  ENSP ID: ENSP00000462294
MQTCPLAFPGHVSQALGTLLFLAASLSAQNEGWDSPICTEGVVSVSWGENTVMSCNISNAFSHVNIKLRAHGQESAIFNEVAPGY

SEQ ID NO: 76975 - protein, 146 aa, Homo sapiens
  Payload ID: 15357
  Gene Symbol: SECTM1
  Gene Name: secreted and transmembrane 1
  ENSP ID: ENSP00000462563
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSEPRGLKDRASAQ

SEQ ID NO: 76976 - protein, 178 aa, Homo sapiens
  Payload ID: 15357
  Gene Symbol: SECTM1
  Gene Name: secreted and transmembrane 1
  ENSP ID: ENSP00000463114
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRR

SEQ ID NO: 76977 - protein, 170 aa, Homo sapiens
  Payload ID: 15357
  Gene Symbol: SECTM1
  Gene Name: secreted and transmembrane 1
  ENSP ID: ENSP00000463120
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSEPRGLKDRASAQLLGPGTSRGAEPQSAPDTGFWPVP

SEQ ID NO: 76978 - protein, 149 aa, Homo sapiens
  Payload ID: 15357
  Gene Symbol: SECTM1
  Gene Name: secreted and transmembrane 1
  ENSP ID: ENSP00000463904
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAAVPSNAGRRSSSS

SEQ ID NO: 76979 - protein, 43 aa, Homo sapiens
  Payload ID: 15357
  Gene Symbol: SECTM1
  Gene Name: secreted and transmembrane 1
  ENSP ID: ENSP00000464111
MQTCPLAFPGHVSQALGTLLFLAASLSAQNEAACPRAGERHLQ

SEQ ID NO: 76980 - protein, 44 aa, Homo sapiens
  Payload ID: 15357
  Gene Symbol: SECTM1
  Gene Name: secreted and transmembrane 1
  ENSP ID: ENSP00000464385
MQTCPLAFPGHVSQALGTLLFLAASLSAQNEGWDSPICTEGVVS

SEQ ID NO: 76981 - protein, 314 aa, Homo sapiens
  Payload ID: 15358
  Gene Symbol: SFRP1
  Gene Name: secreted frizzled-related protein 1
  Uniprot ID: Q8N474
  ENSP ID: ENSP00000220772
MGIGRSEGGRRGAALGVLLALGAALLAVGSASEYDYVSFQSDIGPYQSGRFYTKPPQCVDIPADLRLCHNVGYKKMVLPNLLEHETMAEVKQQASSWVPLLNKNCHAGTQVFLCSLFAPVCLDRPIYPCRWLCEAVRDSCEPVMQFFGFYWPEMLKCDKFPEGDVCIAMTPPNATEASKPQGTTVCPPCDNELKSEAIIEHLCASEFALRMKIKEVKKENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 76982 - protein, 178 aa, Homo sapiens
  Payload ID: 15358
  Gene Symbol: SFRP1
  Gene Name: secreted frizzled-related protein 1
  ENSP ID: ENSP00000369174
MGWGNPIIAVFRTPFAPWLQFHWSAPFSAWLGTVLTHLHSSQQRSGTTVCPPCDNELKSEAIIEHLCASEFALRMKIKEVKKENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 76983 - protein, 295 aa, Homo sapiens
  Payload ID: 15359
  Gene Symbol: SFRP2
  Gene Name: secreted frizzled-related protein 2
  Uniprot ID: Q96HF1
  ENSP ID: ENSP00000274063
MLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 76984 - protein, 137 aa, Homo sapiens
  Payload ID: 15360
  Gene Symbol: SFRP4
  Gene Name: secreted frizzled-related protein 4
  ENSP ID: ENSP00000402262
MQLEQSIIPDIPAKDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENC

SEQ ID NO: 76985 - protein, 346 aa, Homo sapiens
  Payload ID: 15360
  Gene Symbol: SFRP4
  Gene Name: secreted frizzled-related protein 4
  Uniprot ID: Q6FHJ7
  ENSP ID: ENSP00000410715
MFLSILVALCLWLHLALGVRGAPCEAVRIPMCRHMPWNITRMPNHLHHSTQENAILAIEQYEELVDVNCSAVLRFFLCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 76986 - protein, 317 aa, Homo sapiens
  Payload ID: 15361
  Gene Symbol: SFRP5
  Gene Name: secreted frizzled-related protein 5
  Uniprot ID: Q5T4F7
  ENSP ID: ENSP00000266066
MRAAAAGGGVRTAALALLLGALHWAPARCEEYDYYGWQAEPLHGRSYSKPPQCLDIPADLPLCHTVGYKRMRLPNLLEHESLAEVKQQASSWLPLLAKRCHSDTQVFLCSLFAPVCLDRPIYPCRSLCEAVRAGCAPLMEAYGFPWPEMLHCHKFPLDNDLCIAVQFGHLPATAPPVTKICAQCEMEHSADGLMEQMCSSDFVVKMRIKEIKIENGDRKLIGAQKKKKLLKPGPLKRKDTKRLVLHMKNGAGCPCPQLDSLAGSFLVMGRKVDGQLLLMAVYRWDKKNKEMKFAVKFMFSYPCSLYYPFFYGAAEPH

SEQ ID NO: 76987 - protein, 103 aa, Homo sapiens
  Payload ID: 15362
  Gene Symbol: SLURP1
  Gene Name: secreted LY6/PLAUR domain containing 1
  Uniprot ID: P55000
  ENSP ID: ENSP00000246515
MASRWAVQLLLVAAWSMGCGEALKCYTCKEPMTSASCRTITRCKPEDTACMTTLVTVEAEYPFNQSPVVTRSCSSSCVATDPDSIGAAHLIFCCFRDLCNSEL

SEQ ID NO: 76988 - protein, 300 aa, Homo sapiens
  Payload ID: 15363
  Gene Symbol: SPP1
  Gene Name: secreted phosphoprotein 1
  Uniprot ID: P10451
  ENSP ID: ENSP00000237623
MRIAVICFCLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 76989 - protein, 287 aa, Homo sapiens
  Payload ID: 15363
  Gene Symbol: SPP1
  Gene Name: secreted phosphoprotein 1
  Uniprot ID: P10451
  ENSP ID: ENSP00000354042
MRIAVICFCLLGITCAIPVKQADSGSSEEKQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 76990 - protein, 314 aa, Homo sapiens
  Payload ID: 15363
  Gene Symbol: SPP1
  Gene Name: secreted phosphoprotein 1
  Uniprot ID: P10451
  ENSP ID: ENSP00000378517
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 76991 - protein, 241 aa, Homo sapiens
  Payload ID: 15363
  Gene Symbol: SPP1
  Gene Name: secreted phosphoprotein 1
  ENSP ID: ENSP00000422973
MRIAVICFCLLGITCAIPVKQADSGSSEEKQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHE

SEQ ID NO: 76992 - protein, 292 aa, Homo sapiens
  Payload ID: 15363
  Gene Symbol: SPP1
  Gene Name: secreted phosphoprotein 1
  Uniprot ID: P10451
  ENSP ID: ENSP00000477824
MRIAVICFCLLGITCAIPVKQADSGSSEEKQLYNKYPDAVATWLNPDPSQKQNLLAPQNAVSSEETNDFKQETLPSKSNESHDHMDDMDDEDDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 76993 - protein, 211 aa, Homo sapiens
  Payload ID: 15364
  Gene Symbol: SPP2
  Gene Name: secreted phosphoprotein 2, 24kDa
  Uniprot ID: Q13103
  ENSP ID: ENSP00000168148
MISRMEKMTMMMKILIMFALGMNYWSCSGFPVYDYDPSSLRDALSASVVKVNSQSLSPYLFRAFRSSLKRVEVLDENNLVMNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 76994 - protein, 211 aa, Homo sapiens; identical to SEQ ID NO: 76993
  Payload ID: 15364
  Gene Symbol: SPP2
  Gene Name: secreted phosphoprotein 2, 24kDa
  Uniprot ID: Q13103
  ENSP ID: ENSP00000362466

SEQ ID NO: 76995 - protein, 131 aa, Homo sapiens
  Payload ID: 15364
  Gene Symbol: SPP2
  Gene Name: secreted phosphoprotein 2, 24kDa
  ENSP ID: ENSP00000417036
MNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 76996 - protein, 303 aa, Homo sapiens
  Payload ID: 15365
  Gene Symbol: SPARC
  Gene Name: secreted protein, acidic, cysteine-rich (osteonectin)
  Uniprot ID: P09486
  ENSP ID: ENSP00000231061
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 76997 - protein, 115 aa, Homo sapiens
  Payload ID: 15365
  Gene Symbol: SPARC
  Gene Name: secreted protein, acidic, cysteine-rich (osteonectin)
  ENSP ID: ENSP00000428119
MCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRL

SEQ ID NO: 76998 - protein, 53 aa, Homo sapiens
  Payload ID: 15365
  Gene Symbol: SPARC
  Gene Name: secreted protein, acidic, cysteine-rich (osteonectin)
  ENSP ID: ENSP00000429152
MRAWIFFLLCLAGRALAAPQQEALPDETEVVEETVAEVTEVSVGANPVQVEVG

SEQ ID NO: 76999 - protein, 149 aa, Homo sapiens
  Payload ID: 15365
  Gene Symbol: SPARC
  Gene Name: secreted protein, acidic, cysteine-rich (osteonectin)
  ENSP ID: ENSP00000440127
MCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQ

SEQ ID NO: 77000 - protein, 111 aa, Homo sapiens
  Payload ID: 15365
  Gene Symbol: SPARC
  Gene Name: secreted protein, acidic, cysteine-rich (osteonectin)
  ENSP ID: ENSP00000444998
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKV

SEQ ID NO: 77001 - protein, 121 aa, Homo sapiens
  Payload ID: 15366
  Gene Symbol: SCT
  Gene Name: secretin
  Uniprot ID: P09683
  ENSP ID: ENSP00000176195
MAPRPLLLLLLLLGGSAARPAPPRARRHSDGTFTSELSRLREGARLQRLLQGLVGKRSEQDAENSMAWTRLSAGLLCPSGSNMPILQAWMPLDGTWSPWLPPGPMVSEPAGAAAEGTLRPR

SEQ ID NO: 77002 - protein, 121 aa, Homo sapiens; identical to SEQ ID NO: 77001
  Payload ID: 15366
  Gene Symbol: SCT
  Gene Name: secretin
  Uniprot ID: P09683
  ENSP ID: ENSP00000483559

SEQ ID NO: 77003 - protein, 440 aa, Homo sapiens
  Payload ID: 15367
  Gene Symbol: SCTR
  Gene Name: secretin receptor
  Uniprot ID: P47872
  ENSP ID: ENSP00000019103
MRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 77004 - protein, 150 aa, Homo sapiens
  Payload ID: 15367
  Gene Symbol: SCTR
  Gene Name: secretin receptor
  ENSP ID: ENSP00000486930
MWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLV

SEQ ID NO: 77005 - protein, 243 aa, Homo sapiens
  Payload ID: 15367
  Gene Symbol: SCTR
  Gene Name: secretin receptor
  ENSP ID: ENSP00000486987
MPVIPALWEAEVRGSLEPKSSRPAWATWVFSPCSIMLEFPETMGFSKNQTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLV

SEQ ID NO: 77006 - protein, 121 aa, Homo sapiens
  Payload ID: 15368
  Gene Symbol: SAR1A
  Gene Name: secretion associated, Ras related GTPase 1A
  ENSP ID: ENSP00000362333
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNVCFVL

SEQ ID NO: 77007 - protein, 198 aa, Homo sapiens
  Payload ID: 15368
  Gene Symbol: SAR1A
  Gene Name: secretion associated, Ras related GTPase 1A
  Uniprot ID: Q9NR31
  ENSP ID: ENSP00000362335
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNALMTDETISNVPILILGNKIDRTDAISEEKLREIFGLYGQTTGKGNVTLKELNARPMEVFMCSVLKRQGYGEGFRWLSQYID

SEQ ID NO: 77008 - protein, 50 aa, Homo sapiens
  Payload ID: 15368
  Gene Symbol: SAR1A
  Gene Name: secretion associated, Ras related GTPase 1A
  ENSP ID: ENSP00000362336
MSFIFEWIYNGFSSVLQFLGLYKKSGKLVFLGLDNAGKTTLLHMLKDDRL

SEQ ID NO: 77009 - protein, 198 aa, Homo sapiens; identical to SEQ ID NO: 77007
  Payload ID: 15368
  Gene Symbol: SAR1A
  Gene Name: secretion associated, Ras related GTPase 1A
  Uniprot ID: Q9NR31
  ENSP ID: ENSP00000362338

SEQ ID NO: 77010 - protein, 198 aa, Homo sapiens; identical to SEQ ID NO: 77007
  Payload ID: 15368
  Gene Symbol: SAR1A
  Gene Name: secretion associated, Ras related GTPase 1A
  Uniprot ID: Q9NR31
  ENSP ID: ENSP00000362339

SEQ ID NO: 77011 - protein, 115 aa, Homo sapiens
  Payload ID: 15368
  Gene Symbol: SAR1A
  Gene Name: secretion associated, Ras related GTPase 1A
  ENSP ID: ENSP00000398165
  MOD_RES (1)..(1): Any amino acid
XSFWWTVQIILASWNPKLSLMIYCSSLLTLAPNALMTDETISNVPILILGNKIDRTDAISEEKLREIFGLYGQTTGKGNVTLKELNARPMEVFMCSVLKRQGYGEGFRWLSQYID

SEQ ID NO: 77012 - protein, 198 aa, Homo sapiens; identical to SEQ ID NO: 77007
  Payload ID: 15368
  Gene Symbol: SAR1A
  Gene Name: secretion associated, Ras related GTPase 1A
  Uniprot ID: Q9NR31
  ENSP ID: ENSP00000399698

SEQ ID NO: 77013 - protein, 198 aa, Homo sapiens
  Payload ID: 15369
  Gene Symbol: SAR1B
  Gene Name: secretion associated, Ras related GTPase 1B
  Uniprot ID: Q9Y6B6
  ENSP ID: ENSP00000385432
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYID

SEQ ID NO: 77014 - protein, 198 aa, Homo sapiens; identical to SEQ ID NO: 77013
  Payload ID: 15369
  Gene Symbol: SAR1B
  Gene Name: secretion associated, Ras related GTPase 1B
  Uniprot ID: Q9Y6B6
  ENSP ID: ENSP00000404997

SEQ ID NO: 77015 - protein, 103 aa, Homo sapiens
  Payload ID: 15369
  Gene Symbol: SAR1B
  Gene Name: secretion associated, Ras related GTPase 1B
  ENSP ID: ENSP00000423005
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCA

SEQ ID NO: 77016 - protein, 118 aa, Homo sapiens
  Payload ID: 15369
  Gene Symbol: SAR1B
  Gene Name: secretion associated, Ras related GTPase 1B
  ENSP ID: ENSP00000423197
MTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGY

SEQ ID NO: 77017 - protein, 130 aa, Homo sapiens
  Payload ID: 15369
  Gene Symbol: SAR1B
  Gene Name: secretion associated, Ras related GTPase 1B
  ENSP ID: ENSP00000424673
MTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYID

SEQ ID NO: 77018 - protein, 130 aa, Homo sapiens; identical to SEQ ID NO: 77017
  Payload ID: 15369
  Gene Symbol: SAR1B
  Gene Name: secretion associated, Ras related GTPase 1B
  ENSP ID: ENSP00000425339

SEQ ID NO: 77019 - protein, 144 aa, Homo sapiens
  Payload ID: 15369
  Gene Symbol: SAR1B
  Gene Name: secretion associated, Ras related GTPase 1B
  ENSP ID: ENSP00000425367
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDVRYFVKGPNSSRQGQHQIWGHRVSRSMI

SEQ ID NO: 77020 - protein, 170 aa, Homo sapiens
  Payload ID: 15369
  Gene Symbol: SAR1B
  Gene Name: secretion associated, Ras related GTPase 1B
  ENSP ID: ENSP00000425466
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNA

SEQ ID NO: 77021 - protein, 130 aa, Homo sapiens; identical to SEQ ID NO: 77017
  Payload ID: 15369
  Gene Symbol: SAR1B
  Gene Name: secretion associated, Ras related GTPase 1B
  ENSP ID: ENSP00000426335

SEQ ID NO: 77022 - protein, 458 aa, Homo sapiens [sequence omitted]

SEQ ID NO: 77023 - protein, 174 aa, Homo sapiens
  Payload ID: 15370
  Gene Symbol: SERGEF
  Gene Name: secretion regulating guanine nucleotide exchange factor
  ENSP ID: ENSP00000431314
MLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTGLLWLRA

SEQ ID NO: 77024 - protein, 58 aa, Homo sapiens
  Payload ID: 15370
  Gene Symbol: SERGEF
  Gene Name: secretion regulating guanine nucleotide exchange factor
  ENSP ID: ENSP00000431490
MLTENGQVLSCGSNSFGQLGVPHGPRRCVVPQAIELHKEKVVCIAAGLRHAVAATGQH

SEQ ID NO: 77025 - protein, 126 aa, Homo sapiens
  Payload ID: 15370
  Gene Symbol: SERGEF
  Gene Name: secretion regulating guanine nucleotide exchange factor
  ENSP ID: ENSP00000432763
GRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTDTELHSGRCGDEFLELWSQEALQVDSASR

SEQ ID NO: 77026 - protein, 44 aa, Homo sapiens
  Payload ID: 15370
  Gene Symbol: SERGEF
  Gene Name: secretion regulating guanine nucleotide exchange factor
  ENSP ID: ENSP00000433383
PEGRRDVGAAGRGVGSSGAGRLRVQIAMGNLASAIRKMCCCPSN

SEQ ID NO: 77027 - protein, 71 aa, Homo sapiens
  Payload ID: 15370
  Gene Symbol: SERGEF
  Gene Name: secretion regulating guanine nucleotide exchange factor
  ENSP ID: ENSP00000433870
MLTENGQVLSCGSNSFGQLGVPHGPRRCVVPQAIEKYSFQKKEGQSSALSAVQPASGMLCFVVDLVLRPWA

SEQ ID NO: 77028 - protein, 40 aa, Homo sapiens
  Payload ID: 15370
  Gene Symbol: SERGEF
  Gene Name: secretion regulating guanine nucleotide exchange factor
  ENSP ID: ENSP00000433884
MEREPSASEAAPAAAALFAWVSSKTNIFKRFYFSSPGRTS

SEQ ID NO: 77029 - protein, 288 aa, Homo sapiens
  Payload ID: 15370
  Gene Symbol: SERGEF
  Gene Name: secretion regulating guanine nucleotide exchange factor
  Uniprot ID: Q9UGK8
  ENSP ID: ENSP00000434188
MEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTGLLWLRA

SEQ ID NO: 77030 - protein, 354 aa, Homo sapiens
  Payload ID: 15370
  Gene Symbol: SERGEF
  Gene Name: secretion regulating guanine nucleotide exchange factor
  ENSP ID: ENSP00000434330
MEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATETSFRWHLLGKSSLMSRS

SEQ ID NO: 77031 - protein, 144 aa, Homo sapiens
  Payload ID: 15370
  Gene Symbol: SERGEF
  Gene Name: secretion regulating guanine nucleotide exchange factor
  ENSP ID: ENSP00000435003
  MOD_RES (1)..(1): Any amino acid
XDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIVSLQGKYYYPSFADVEMELQRN

SEQ ID NO: 77032 - protein, 137 aa, Homo sapiens
  Payload ID: 15370
  Gene Symbol: SERGEF
  Gene Name: secretion regulating guanine nucleotide exchange factor
  ENSP ID: ENSP00000435898
MLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFL

SEQ ID NO: 77033 - protein, 164 aa, Homo sapiens
  Payload ID: 15370
  Gene Symbol: SERGEF
  Gene Name: secretion regulating guanine nucleotide exchange factor
  ENSP ID: ENSP00000436080
MLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLV

SEQ ID NO: 77034 - protein, 299 aa, Homo sapiens
  Payload ID: 15370
  Gene Symbol: SERGEF
  Gene Name: secretion regulating guanine nucleotide exchange factor
  ENSP ID: ENSP00000436111
  MOD_RES (1)..(1): Any amino acid
XEVPPSPESCCHMLHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKER

SEQ ID NO: 77035 - protein, 105 aa, Homo sapiens
  Payload ID: 15370
  Gene Symbol: SERGEF
  Gene Name: secretion regulating guanine nucleotide exchange factor
  ENSP ID: ENSP00000436648
GQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTGLLWLRA

SEQ ID NO: 77036 - protein, 228 aa, Homo sapiens
  Payload ID: 15370
  Gene Symbol: SERGEF
  Gene Name: secretion regulating guanine nucleotide exchange factor
  ENSP ID: ENSP00000437297
MLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVGSDF

SEQ ID NO: 77037 - protein, 91 aa, Homo sapiens
  Payload ID: 15371
  Gene Symbol: SCGB1A1
  Gene Name: secretoglobin, family 1A, member 1 (uteroglobin)
  Uniprot ID: P11684
  ENSP ID: ENSP00000278282
MKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 77038 - protein, 56 aa, Homo sapiens
  Payload ID: 15371
  Gene Symbol: SCGB1A1
  Gene Name: secretoglobin, family 1A, member 1 (uteroglobin)
  ENSP ID: ENSP00000432866
MDTPSSYEAAMELFSPDQDMREAGAQLKKLVDTLPQKPRESIIKLMEKIAQSSLCN

SEQ ID NO: 77039 - protein, 95 aa, Homo sapiens
  Payload ID: 15372
  Gene Symbol: SCGB1C1
  Gene Name: secretoglobin, family 1C, member 1
  Uniprot ID: Q8TD33
  ENSP ID: ENSP00000344545
MKGSRALLLVALTLFCICRMATGEDNDEFFMDFLQTLLVGTPEELYEGTLGKYNVNEDAKAAMTELKSCIDGLQPMHKAELVKLLVQVLGSQDGA

SEQ ID NO: 77040 - protein, 95 aa, Homo sapiens
  Payload ID: 15373
  Gene Symbol: SCGB1C2
  Gene Name: secretoglobin, family 1C, member 2
  Uniprot ID: P0DMR2
  ENSP ID: ENSP00000471646
MKGSRALLLVALTLFCICRMATGEDNDEFFMDFLQTLLVGTPEELYEGTLGKYNVNEDAKAAMTELKSCRDGLQPMHKAELVKLLVQVLGSQDGA

SEQ ID NO: 77041 - protein, 95 aa, Homo sapiens; identical to SEQ ID NO: 77040
  Payload ID: 15373
  Gene Symbol: SCGB1C2
  Gene Name: secretoglobin, family 1C, member 2
  Uniprot ID: P0DMR2
  ENSP ID: ENSP00000479313

SEQ ID NO: 77042 - protein, 90 aa, Homo sapiens
  Payload ID: 15374
  Gene Symbol: SCGB1D1
  Gene Name: secretoglobin, family 1D, member 1
  Uniprot ID: O95968
  ENSP ID: ENSP00000303070
MRLSVCLLLLTLALCCYRANAVVCQALGSEITGFLLAGKPVFKFQLAKFKAPLEAVAAKMEVKKCVDTMAYEKRVLITKTLGKIAEKCDR

SEQ ID NO: 77043 - protein, 90 aa, Homo sapiens
  Payload ID: 15375
  Gene Symbol: SCGB1D2
  Gene Name: secretoglobin, family 1D, member 2
  Uniprot ID: O95969
  ENSP ID: ENSP00000244926
MKLSVCLLLVTLALCCYQANAEFCPALVSELLDFFFISEPLFKLSLAKFDAPPEAVAAKLGVKRCTDQMSLQKRSLIAEVLVKILKKCSV

SEQ ID NO: 77044 - protein, 83 aa, Homo sapiens
  Payload ID: 15376
  Gene Symbol: SCGB1D4
  Gene Name: secretoglobin, family 1D, member 4
  Uniprot ID: Q6XE38
  ENSP ID: ENSP00000351395
MRLSVCLLMVSLALCCYQAHALVCPAVASEITVFLFLSDAAVNLQVAKLNPPPEALAAKLEVKHCTDQISFKKRLSLKKSWWK

SEQ ID NO: 77045 - protein, 95 aa, Homo sapiens
  Payload ID: 15377
  Gene Symbol: SCGB2A1
  Gene Name: secretoglobin, family 2A, member 1
  Uniprot ID: O75556
  ENSP ID: ENSP00000244930
MKLLMVLMLAALLLHCYADSGCKLLEDMVEKTINSDISIPEYKELLQEFIDSDAAAEAMGKFKQCFLNQSHRTLKNFGLMMHTVYDSIWCNMKSN

SEQ ID NO: 77046 - protein, 93 aa, Homo sapiens
  Payload ID: 15378
  Gene Symbol: SCGB2A2
  Gene Name: secretoglobin, family 2A, member 2
  Uniprot ID: Q13296
  ENSP ID: ENSP00000227918
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 77047 - protein, 120 aa, Homo sapiens
  Payload ID: 15378
  Gene Symbol: SCGB2A2
  Gene Name: secretoglobin, family 2A, member 2
  ENSP ID: ENSP00000431997
MKLLMVLMLAALSQHCYAGSGCPLLENVISKTINPQVSKTEYKELLQEFIDDNATTNAIDELKECFLNQTDETLSNVEVFMVISFSSYKLFKSPDQGQVGSSFLTDNAKATSEQAFSYIG

SEQ ID NO: 77048 - protein, 96 aa, Homo sapiens
  Payload ID: 15379
  Gene Symbol: SCGB2B2
  Gene Name: secretoglobin, family 2B, member 2
  Uniprot ID: Q4G0G5
  ENSP ID: ENSP00000368502
MRVTSATCALLLALICSVQLGDACLDIDKLLANVVFDVSQDLLKEELARYNPSPLTEESFLNVQQCFANVSVTERFAHSVVIKKILQSNDCIEAAF

SEQ ID NO: 77049 - protein, 96 aa, Homo sapiens; identical to SEQ ID NO: 77048
  Payload ID: 15379
  Gene Symbol: SCGB2B2
  Gene Name: secretoglobin, family 2B, member 2
  Uniprot ID: Q4G0G5
  ENSP ID: ENSP00000469876

SEQ ID NO: 77050 - protein, 104 aa, Homo sapiens
  Payload ID: 15380
  Gene Symbol: SCGB3A1
  Gene Name: secretoglobin, family 3A, member 1
  Uniprot ID: Q96QR1
  ENSP ID: ENSP00000292641
MKLAALLGLCVALSCSSAAAFLVGSAKPVAQPVAALESAAEAGAGTLANPLGTLNPLKLLLSSLGIPVNHLIEGSQKCVAELGPQAVGAVKALKALLGALTVFG

SEQ ID NO: 77051 - protein, 93 aa, Homo sapiens
  Payload ID: 15381
  Gene Symbol: SCGB3A2
  Gene Name: secretoglobin, family 3A, member 2
  Uniprot ID: Q96PL1
  ENSP ID: ENSP00000296694
MKLVTIFLLVTISLCSYSATAFLINKVPLPVDKLAPLPLDNILPFMDPLKLLLKTLGISVEHLVEGLRKCVNELGPEASEAVKKLLEALSHLV

SEQ ID NO: 77052 - protein, 48 aa, Homo sapiens
  Payload ID: 15381
  Gene Symbol: SCGB3A2
  Gene Name: secretoglobin, family 3A, member 2
  ENSP ID: ENSP00000423930
MDPLKLLLKTLGISVEHLVEGLRKCVNELGPEASEAVKKLLEALSHLV

SEQ ID NO: 77053 - protein, 617 aa, Homo sapiens
  Payload ID: 15382
  Gene Symbol: SCG2
  Gene Name: secretogranin II
  Uniprot ID: P13521
  ENSP ID: ENSP00000304133
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFPMDMSDDYETQQWPERKLKHMQFPPMYEENSRDNPFKRTNEIVEEQYTPQSLATLESVFQELGKLTGPNNQKRERMDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 77054 - protein, 144 aa, Homo sapiens
  Payload ID: 15382
  Gene Symbol: SCG2
  Gene Name: secretogranin II
  ENSP ID: ENSP00000394702
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFP

SEQ ID NO: 77055 - protein, 125 aa, Homo sapiens
  Payload ID: 15382
  Gene Symbol: SCG2
  Gene Name: secretogranin II
  ENSP ID: ENSP00000415468
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEP

SEQ ID NO: 77056 - protein, 468 aa, Homo sapiens
  Payload ID: 15383
  Gene Symbol: SCG3
  Gene Name: secretogranin III
  Uniprot ID: Q8WXD2
  ENSP ID: ENSP00000220478
MGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 77057 - protein, 236 aa, Homo sapiens
  Payload ID: 15383
  Gene Symbol: SCG3
  Gene Name: secretogranin III
  Uniprot ID: Q8WXD2
  ENSP ID: ENSP00000445205
MAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 77058 - protein, 57 aa, Homo sapiens
  Payload ID: 15383
  Gene Symbol: SCG3
  Gene Name: secretogranin III
  ENSP ID: ENSP00000452745
MAAIQDGLAKGENDETVSNTLTLTNGLERRTKTYSEDNFEELQYFPNFYALLKSIDS

SEQ ID NO: 77059 - protein, 212 aa, Homo sapiens
  Payload ID: 15384
  Gene Symbol: SCG5
  Gene Name: secretogranin V
  Uniprot ID: P05408
  ENSP ID: ENSP00000300175
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 77060 - protein, 211 aa, Homo sapiens
  Payload ID: 15384
  Gene Symbol: SCG5
  Gene Name: secretogranin V
  Uniprot ID: P05408
  ENSP ID: ENSP00000388560
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTDDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 77061 - protein, 193 aa, Homo sapiens
  Payload ID: 15384
  Gene Symbol: SCG5
  Gene Name: secretogranin V
  ENSP ID: ENSP00000418430
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTDDGCLENTPDTAEFSREFQLHQHLFDPEHDYPGLGKWSVNPYLQGQRLDNVVAKKSVPHFSDEDKDPE

SEQ ID NO: 77062 - protein, 216 aa, Homo sapiens
  Payload ID: 15384
  Gene Symbol: SCG5
  Gene Name: secretogranin V
  ENSP ID: ENSP00000418485
SGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRVTRAWLDCCGDAWSFLSGAVNRLKPSLVGKSQNPPLCSPEKHWSM

SEQ ID NO: 77063 - protein, 194 aa, Homo sapiens
  Payload ID: 15384
  Gene Symbol: SCG5
  Gene Name: secretogranin V
  ENSP ID: ENSP00000420347
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWSVNPYLQGQRLDNVVAKKSVPHFSDEDKDPE

SEQ ID NO: 77064 - protein, 212 aa, Homo sapiens; identical to SEQ ID NO: 77059
  Payload ID: 15384
  Gene Symbol: SCG5
  Gene Name: secretogranin V
  ENSP ID: ENSP00000482615

SEQ ID NO: 77065 - protein, 216 aa, Homo sapiens; identical to SEQ ID NO: 77062
  Payload ID: 15384
  Gene Symbol: SCG5
  Gene Name: Secretogranin V
  ENSP ID: ENSP00000487899

SEQ ID NO: 77066 - protein, 212 aa, Homo sapiens; identical to SEQ ID NO: 77059
  Payload ID: 15384
  Gene Symbol: SCG5
  Gene Name: Secretogranin V
  ENSP ID: ENSP00000488109

SEQ ID NO: 77067 - protein, 211 aa, Homo sapiens; identical to SEQ ID NO: 77060
  Payload ID: 15384
  Gene Symbol: SCG5
  Gene Name: Secretogranin V
  ENSP ID: ENSP00000488509

SEQ ID NO: 77068 - protein, 194 aa, Homo sapiens; identical to SEQ ID NO: 77063
  Payload ID: 15384
  Gene Symbol: SCG5
  Gene Name: Secretogranin V
  ENSP ID: ENSP00000488565

SEQ ID NO: 77069 - protein, 193 aa, Homo sapiens; identical to SEQ ID NO: 77061
  Payload ID: 15384
  Gene Symbol: SCG5
  Gene Name: Secretogranin V
  ENSP ID: ENSP00000488899

SEQ ID NO: 77070 - protein, 157 aa, Homo sapiens
  Payload ID: 15385
  Gene Symbol: SCAMP1
  Gene Name: secretory carrier membrane protein 1
  Uniprot ID: O15126
  ENSP ID: ENSP00000478071
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWM

SEQ ID NO: 77071 - protein, 42 aa, Homo sapiens
  Payload ID: 15385
  Gene Symbol: SCAMP1
  Gene Name: secretory carrier membrane protein 1
  ENSP ID: ENSP00000478205
MPNVPNTQPAIMKPTEEHPAYTQIAKEHALAQAELLKRQEEL

SEQ ID NO: 77072 - protein, 206 aa, Homo sapiens
  Payload ID: 15385
  Gene Symbol: SCAMP1
  Gene Name: secretory carrier membrane protein 1
  ENSP ID: ENSP00000478292
  MOD_RES (1)..(1): Any amino acid
XELDRREREMQNLSQHGRKNNWPPLPSNFPVGPCFYQDFSVDIPVEFQKTVKLMYYLWMFHAVTLFLNIFGCLAWFCVDSARAVDFGLSILWFLLFTPCSFVCWYRPLYGAFSGWISSLTGLNQNIPVGIMMIIIAALFTASAVISLVMFKKVHGLYRTTGASFEKAQQEFATGVMSNKTVQTAAANAASTAASSAAQNAFKGNQI

SEQ ID NO: 77073 - protein, 312 aa, Homo sapiens
  Payload ID: 15385
  Gene Symbol: SCAMP1
  Gene Name: secretory carrier membrane protein 1
  ENSP ID: ENSP00000480865
MSDFDSNPFADPDLNNPFKPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWMFHAVTLFLNIFGCLAWFCVDSARAVDFGLSILWFLLFTPCSFVCWYRPLYGAFRSDSSFRFFVFFFVYICQFAVHVLQAAGFHNWGNCGWISSLTGLNQNIPVGIMMIIIAALFTASAVISLVMFKKVHGLYRTTGASFEKAQQEFATGVMSNKTVQTAAANAASTAASSAAQNAFKGNQI

SEQ ID NO: 77074 - protein, 338 aa, Homo sapiens
  Payload ID: 15385
  Gene Symbol: SCAMP1
  Gene Name: secretory carrier membrane protein 1
  Uniprot ID: O15126
  ENSP ID: ENSP00000481022
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWMFHAVTLFLNIFGCLAWFCVDSARAVDFGLSILWFLLFTPCSFVCWYRPLYGAFRSDSSFRFFVFFFVYICQFAVHVLQAAGFHNWGNCGWISSLTGLNQNIPVGIMMIIIAALFTASAVISLVMFKKVHGLYRTTGASFEKAQQEFATGVMSNKTVQTAAANAASTAASSAAQNAFKGNQI

SEQ ID NO: 77075 - protein, 119 aa, Homo sapiens
  Payload ID: 15385
  Gene Symbol: SCAMP1
  Gene Name: secretory carrier membrane protein 1
  ENSP ID: ENSP00000482491
MVTLFNHGGASRPFSKVAVPFYIPASSVWDPSVTQVTRNVPPGLDEYNPFSDSRTPPPGGVKMPNVPNTQPAIMKPTEEHPAYTQIAKEHALAQAELLKRQEELERKAAELDRREREMQ

SEQ ID NO: 77076 - protein, 329 aa, Homo sapiens
  Payload ID: 15386
  Gene Symbol: SCAMP2
  Gene Name: secretory carrier membrane protein 2
  Uniprot ID: O15127
  ENSP ID: ENSP00000268099
MSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 77077 - protein, 93 aa, Homo sapiens
  Payload ID: 15386
  Gene Symbol: SCAMP2
  Gene Name: secretory carrier membrane protein 2
  ENSP ID: ENSP00000454464
MLYYLWMLHSVTLFLNLLACLAWFSGNSSKGVDFGLSILWFLIFTPCAFLCWYRPIYKAFRSDNSFSFFVFFFVFFCQIGIYIIQLVGIPGLG

SEQ ID NO: 77078 - protein, 236 aa, Homo sapiens
  Payload ID: 15386
  Gene Symbol: SCAMP2
  Gene Name: secretory carrier membrane protein 2
  ENSP ID: ENSP00000454741
MSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRDLHHPVGWHPWPGGQRLDCSPVYTG

SEQ ID NO: 77079 - protein, 278 aa, Homo sapiens
  Payload ID: 15386
  Gene Symbol: SCAMP2
  Gene Name: secretory carrier membrane protein 2
  ENSP ID: ENSP00000455377
SETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVSGVGRADSKWEEAGNRFLPLPRDVFHHCSWAS

SEQ ID NO: 77080 - protein, 57 aa, Homo sapiens
  Payload ID: 15386
  Gene Symbol: SCAMP2
  Gene Name: secretory carrier membrane protein 2
  ENSP ID: ENSP00000455963
MSAFDTNPFADPVDVNPFQDPSVTQLTNAPQGGLAEFNPFSEPCLHWIIIPWPYQSS

SEQ ID NO: 77081 - protein, 254 aa, Homo sapiens
  Payload ID: 15386
  Gene Symbol: SCAMP2
  Gene Name: secretory carrier membrane protein 2
  ENSP ID: ENSP00000457564
MSAFDTNPFADPVDVNPFQDPSVTQLTNAPQGGLAEFNPFSETNAATTVPVTQLPGSSQPAVLQPSVEPTQPTPQLLLRQASKFPPAQFLAVSELSERQMLLGGESILRDSYMRKLPKAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFR

SEQ ID NO: 77082 - protein, 194 aa, Homo sapiens
  Payload ID: 15386
  Gene Symbol: SCAMP2
  Gene Name: secretory carrier membrane protein 2
  ENSP ID: ENSP00000457890
MSAFDTNPFADPVDVNPFQTNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFS

SEQ ID NO: 77083 - protein, 347 aa, Homo sapiens
  Payload ID: 15387
  Gene Symbol: SCAMP3
  Gene Name: secretory carrier membrane protein 3
  Uniprot ID: O14828
  ENSP ID: ENSP00000307275
MAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNFFVFFFIFFVQDVLFVLQAIGIPGWGFSGWISALVVPKGNTAVSVLMLLVALLFTGIAVLGIVMLKRIHSLYRRTGASFQKAQQEFAAGVFSNPAVRTAAANAAAGAAENAFRAP

SEQ ID NO: 77084 - protein, 321 aa, Homo sapiens
  Payload ID: 15387
  Gene Symbol: SCAMP3
  Gene Name: secretory carrier membrane protein 3
  Uniprot ID: O14828
  ENSP ID: ENSP00000347540
MAQSRDGGNPFAEPSELDNPFQPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNFFVFFFIFFVQDVLFVLQAIGIPGWGFSGWISALVVPKGNTAVSVLMLLVALLFTGIAVLGIVMLKRIHSLYRRTGASFQKAQQEFAAGVFSNPAVRTAAANAAAGAAENAFRAP

SEQ ID NO: 77085 - protein, 321 aa, Homo sapiens; identical to SEQ ID NO: 77084
  Payload ID: 15387
  Gene Symbol: SCAMP3
  Gene Name: secretory carrier membrane protein 3
  Uniprot ID: O14828
  ENSP ID: ENSP00000458542

SEQ ID NO: 77086 - protein, 347 aa, Homo sapiens; identical to SEQ ID NO: 77083
  Payload ID: 15387
  Gene Symbol: SCAMP3
  Gene Name: secretory carrier membrane protein 3
  Uniprot ID: O14828
  ENSP ID: ENSP00000461521

SEQ ID NO: 77087 - protein, 229 aa, Homo sapiens
  Payload ID: 15388
  Gene Symbol: SCAMP4
  Gene Name: secretory carrier membrane protein 4
  Uniprot ID: Q969E2
  ENSP ID: ENSP00000316007
MSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRADSSFNFMAFFFIFGAQFVLTVIQAIGFSGWGACGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 77088 - protein, 195 aa, Homo sapiens
  Payload ID: 15388
  Gene Symbol: SCAMP4
  Gene Name: secretory carrier membrane protein 4
  Uniprot ID: Q969E2
  ENSP ID: ENSP00000386865
MSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 77089 - protein, 123 aa, Homo sapiens
  Payload ID: 15388
  Gene Symbol: SCAMP4
  Gene Name: secretory carrier membrane protein 4
  ENSP ID: ENSP00000388185
MSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRADSSFNFMAFFFIFGAQFVLTVIQA

SEQ ID NO: 77090 - protein, 57 aa, Homo sapiens
  Payload ID: 15388
  Gene Symbol: SCAMP4
  Gene Name: secretory carrier membrane protein 4
  ENSP ID: ENSP00000465199
MSEKENNFPPLPKFIPVKPCFYQNFSDEIPVEHQVLVKRIYRLWMFYCATLGVNLIA

SEQ ID NO: 77091 - protein, 22 aa, Homo sapiens
  Payload ID: 15388
  Gene Symbol: SCAMP4
  Gene Name: secretory carrier membrane protein 4
  ENSP ID: ENSP00000478264
MFYCATLGVNLIACLAWWIGGG

SEQ ID NO: 77092 - protein, 229 aa, Homo sapiens; identical to SEQ ID NO: 77087
  Payload ID: 15388
  Gene Symbol: SCAMP4
  Gene Name: secretory carrier membrane protein 4
  Uniprot ID: Q969E2
  ENSP ID: ENSP00000479083

SEQ ID NO: 77093 - protein, 140 aa, Homo sapiens
  Payload ID: 15388
  Gene Symbol: SCAMP4
  Gene Name: secretory carrier membrane protein 4
  ENSP ID: ENSP00000479672
MFYCATLGVNLIACLAWWIGGGSGTNFGLAFVWLLLFTPCGYVCWFRPVYKAFRADSSFNFMAFFFIFGAQFVLTVIQAIGFSGWGACGWLSAIGFFQYSPGAAVVMLLPAIMFSVSAAMMAIAIMKVHRIYRGAGGSFQ

SEQ ID NO: 77094 - protein, 35 aa, Homo sapiens
  Payload ID: 15388
  Gene Symbol: SCAMP4
  Gene Name: secretory carrier membrane protein 4
  ENSP ID: ENSP00000481989
MSGAQGHFLRQCWLSRSSWGAPSATLSAPKAVFPS

SEQ ID NO: 77095 - protein, 235 aa, Homo sapiens
  Payload ID: 15389
  Gene Symbol: SCAMP5
  Gene Name: secretory carrier membrane protein 5
  Uniprot ID: Q8TAC9
  ENSP ID: ENSP00000355387
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 77096 - protein, 235 aa, Homo sapiens; identical to SEQ ID NO: 77095
  Payload ID: 15389
  Gene Symbol: SCAMP5
  Gene Name: secretory carrier membrane protein 5
  Uniprot ID: Q8TAC9
  ENSP ID: ENSP00000406547

SEQ ID NO: 77097 - protein, 168 aa, Homo sapiens
  Payload ID: 15389
  Gene Symbol: SCAMP5
  Gene Name: secretory carrier membrane protein 5
  ENSP ID: ENSP00000454602
MHLNLEGLGGLEGREALALCPGDGSHLLCRRTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 77098 - protein, 95 aa, Homo sapiens
  Payload ID: 15389
  Gene Symbol: SCAMP5
  Gene Name: secretory carrier membrane protein 5
  ENSP ID: ENSP00000454766
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYK

SEQ ID NO: 77099 - protein, 123 aa, Homo sapiens
  Payload ID: 15389
  Gene Symbol: SCAMP5
  Gene Name: secretory carrier membrane protein 5
  ENSP ID: ENSP00000454860
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQA

SEQ ID NO: 77100 - protein, 148 aa, Homo sapiens
  Payload ID: 15389
  Gene Symbol: SCAMP5
  Gene Name: secretory carrier membrane protein 5
  ENSP ID: ENSP00000455039
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSA

SEQ ID NO: 77101 - protein, 45 aa, Homo sapiens
  Payload ID: 15389
  Gene Symbol: SCAMP5
  Gene Name: secretory carrier membrane protein 5
  ENSP ID: ENSP00000455203
MAEKVNNFPPLPKFIPLKPCFYQDFEADIPPQHVSMTKRLYYLWM

SEQ ID NO: 77102 - protein, 243 aa, Homo sapiens
  Payload ID: 15389
  Gene Symbol: SCAMP5
  Gene Name: secretory carrier membrane protein 5
  Uniprot ID: Q8TAC9
  ENSP ID: ENSP00000455313
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCPTLASSCSGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 77103 - protein, 45 aa, Homo sapiens; identical to SEQ ID NO: 77101
  Payload ID: 15389
  Gene Symbol: SCAMP5
  Gene Name: secretory carrier membrane protein 5
  ENSP ID: ENSP00000455598

SEQ ID NO: 77104 - protein, 116 aa, Homo sapiens
  Payload ID: 15389
  Gene Symbol: SCAMP5
  Gene Name: secretory carrier membrane protein 5
  ENSP ID: ENSP00000456505
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQL

SEQ ID NO: 77105 - protein, 97 aa, Homo sapiens
  Payload ID: 15389
  Gene Symbol: SCAMP5
  Gene Name: secretory carrier membrane protein 5
  ENSP ID: ENSP00000456991
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAF

SEQ ID NO: 77106 - protein, 69 aa, Homo sapiens
  Payload ID: 15389
  Gene Symbol: SCAMP5
  Gene Name: secretory carrier membrane protein 5
  ENSP ID: ENSP00000457121
MAEKVNNFPPLPKFIPLKPCFYQDFEADIPPQHVSMTKRLYYLWMLNSVTLAVNLVGCLAWLIGGGGAT

SEQ ID NO: 77107 - protein, 46 aa, Homo sapiens
  Payload ID: 15389
  Gene Symbol: SCAMP5
  Gene Name: secretory carrier membrane protein 5
  ENSP ID: ENSP00000457444
MAEKVNNFPPLPKFIPLKPCFYQDFEADIPPQHVSMTKRLYYLWMC

SEQ ID NO: 77108 - protein, 45 aa, Homo sapiens; identical to SEQ ID NO: 77101
  Payload ID: 15389
  Gene Symbol: SCAMP5
  Gene Name: secretory carrier membrane protein 5
  ENSP ID: ENSP00000457520

SEQ ID NO: 77109 - protein, 45 aa, Homo sapiens; identical to SEQ ID NO: 77101
  Payload ID: 15389
  Gene Symbol: SCAMP5
  Gene Name: secretory carrier membrane protein 5
  ENSP ID: ENSP00000458072

SEQ ID NO: 77110 - protein, 132 aa, Homo sapiens
  Payload ID: 15390
  Gene Symbol: SLPI
  Gene Name: secretory leukocyte peptidase inhibitor
  Uniprot ID: P03973
  ENSP ID: ENSP00000342082
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 77111 - protein, 478 aa, Homo sapiens; identical to SEQ ID NO: 75739
  Payload ID: 15391
  Gene Symbol: SHPK
  Gene Name: sedoheptulokinase
  Uniprot ID: Q9UHJ6
  ENSP ID: ENSP00000225519

SEQ ID NO: 77112 - protein, 360 aa, Homo sapiens
  Payload ID: 15392
  Gene Symbol: SEH1L
  Gene Name: SEH1-like nucleoporin
  Uniprot ID: Q96EE3
  ENSP ID: ENSP00000262124
MFVARSIAADHKDLIHDVSFDFHGRRMATCSSDQSVKVWDKSESGDWHCTASWKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSTIPSLQNSLNGSSAGRKHS

SEQ ID NO: 77113 - protein, 421 aa, Homo sapiens
  Payload ID: 15392
  Gene Symbol: SEH1L
  Gene Name: SEH1-like nucleoporin
  Uniprot ID: Q96EE3
  ENSP ID: ENSP00000382779
MFVARSIAADHKDLIHDVSFDFHGRRMATCSSDQSVKVWDKSESGDWHCTASWKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSTIPSLQNSLNGSSAGRYFFTPLDSPRAGSRWSSYAQLLPPPPPPLVEHSCDADTANLQYPHPRRRYLSRPLNPLPENEGI

SEQ ID NO: 77114 - protein, 263 aa, Homo sapiens
  Payload ID: 15392
  Gene Symbol: SEH1L
  Gene Name: SEH1-like nucleoporin
  ENSP ID: ENSP00000466234
MFVARSIAADHKDLIHDVSFDFHGRRMATCSSDQSVKVWDKSESGDWHCTASWKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSRISKLIEKMNRAHLYNFHIPSSRAHSPMIAVGSDDSSPNAMAKVQIFEYNENTRKYAKAETLMTVTDPVHDIAFAPNLGRSFHILAIATK

SEQ ID NO: 77115 - protein, 158 aa, Homo sapiens
  Payload ID: 15392
  Gene Symbol: SEH1L
  Gene Name: SEH1-like nucleoporin
  ENSP ID: ENSP00000466959
MFVARSIAADHKDLIHDVSFDFHGRRMATCSSDQSVKVWDKSESGDWHCTASWKVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTR

SEQ ID NO: 77116 - protein, 189 aa, Homo sapiens
  Payload ID: 15392
  Gene Symbol: SEH1L
  Gene Name: SEH1-like nucleoporin
  ENSP ID: ENSP00000467276
MFVARSIAADHKDLIHDVSFDFHGRRMATCSSDQSVKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENT

SEQ ID NO: 77117 - protein, 77 aa, Homo sapiens
  Payload ID: 15392
  Gene Symbol: SEH1L
  Gene Name: SEH1-like nucleoporin
  ENSP ID: ENSP00000467605
MATCSSDQSVKVWDKSESGDWHCTASWKTHSGSVWRVTWAHPEFGQVLASCSFDRTAAVWEEIVGESNDKLRGQSHW

SEQ ID NO: 77118 - protein, 994 aa, Homo sapiens
  Payload ID: 15393
  Gene Symbol: SEZ6
  Gene Name: seizure related 6 homolog (mouse)
  Uniprot ID: Q53EL9
  ENSP ID: ENSP00000312942
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 77119 - protein, 994 aa, Homo sapiens
  Payload ID: 15393
  Gene Symbol: SEZ6
  Gene Name: seizure related 6 homolog (mouse)
  ENSP ID: ENSP00000337407
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIGECPGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGSTTVAAWMVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 77120 - protein, 993 aa, Homo sapiens
  Payload ID: 15393
  Gene Symbol: SEZ6
  Gene Name: seizure related 6 homolog (mouse)
  Uniprot ID: Q53EL9
  ENSP ID: ENSP00000353440
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGETREYEVSI

SEQ ID NO: 77121 - protein, 980 aa, Homo sapiens
  Payload ID: 15393
  Gene Symbol: SEZ6
  Gene Name: seizure related 6 homolog (mouse)
  ENSP ID: ENSP00000403784
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAVAKAPAASSTLDAAHIAAAIFLPLVAMVLLVGGVYFYFSRLQGKSSLQLPRPRPRPYNRITIESAFDNPTYETGETREYEVSI

SEQ ID NO: 77122 - protein, 919 aa, Homo sapiens
  Payload ID: 15393
  Gene Symbol: SEZ6
  Gene Name: seizure related 6 homolog (mouse)
  ENSP ID: ENSP00000437650
EFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGETREYEVSI

SEQ ID NO: 77123 - protein, 101 aa, Homo sapiens
  Payload ID: 15393
  Gene Symbol: SEZ6
  Gene Name: seizure related 6 homolog (mouse)
  ENSP ID: ENSP00000440216
  MOD_RES (1)..(1): Any amino acid
XLDAAHIAAAIFLPLVAMVLLVGGVYFYFSRRRCHQALKKLCPSPPAMPTMAYFLGVIAHLGPFIGPMSGGIYLWEEHSWSTSINSQHPEPPHALDQPGTH

SEQ ID NO: 77124 - protein, 454 aa, Homo sapiens
  Payload ID: 15393
  Gene Symbol: SEZ6
  Gene Name: seizure related 6 homolog (mouse)
  ENSP ID: ENSP00000440764
  MOD_RES (1)..(1): Any amino acid
XGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAAHPPTLWVPLWSSAATLATPWSRAPSSSSVLTPTTPSGMRQSQPAEPCAAGRSQTRLAWYSLPTGQSPTVVGRIVSGVCMWKRTSASCWTSECCA

SEQ ID NO: 77125 - protein, 131 aa, Homo sapiens
  Payload ID: 15393
  Gene Symbol: SEZ6
  Gene Name: seizure related 6 homolog (mouse)
  ENSP ID: ENSP00000443589
  MOD_RES (1)..(1): Any amino acid
XACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEGEPAGASLGVAGPRGWARA

SEQ ID NO: 77126 - protein, 56 aa, Homo sapiens
  Payload ID: 15393
  Gene Symbol: SEZ6
  Gene Name: seizure related 6 homolog (mouse)
  ENSP ID: ENSP00000466107
MAAVPTQPQSKEGPWSPESESPMLRITAPLPPGPSMAVPTLGPGEIASTTPPSRAW

SEQ ID NO: 77127 - protein, 1024 aa, Homo sapiens
  Payload ID: 15394
  Gene Symbol: SEZ6L
  Gene Name: seizure related 6 homolog (mouse)-like
  Uniprot ID: Q9BYH1
  ENSP ID: ENSP00000248933
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEVAEAAAETSLEGGNMALAIFIPVLIISLLLGGAYIYITRCRYYSNLRLPLMYSHPYSQITVETEFDNPIYETGETREYEVSI

SEQ ID NO: 77128 - protein, 948 aa, Homo sapiens
  Payload ID: 15394
  Gene Symbol: SEZ6L
  Gene Name: seizure related 6 homolog (mouse)-like
  Uniprot ID: Q9BYH1
  ENSP ID: ENSP00000342661
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVLAEAAAETSLEGGNMALAIFIPVLIISLLLGGAYIYITRCRYYSNLRLPLMYSHPYSQITVETEFDNPIYETGETREYEVSI

SEQ ID NO: 77129 - protein, 949 aa, Homo sapiens
  Payload ID: 15394
  Gene Symbol: SEZ6L
  Gene Name: seizure related 6 homolog (mouse)-like
  Uniprot ID: Q9BYH1
  ENSP ID: ENSP00000354185
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKTEESLACDNPGLPENGYQILYKRLYLPGESLTFMCYEGFELMGEVTIRCILGQPSHWNGPLPVCKVAEAAAETSLEGGNMALAIFIPVLIISLLLGGAYIYITRCRYYSNLRLPLMYSHPYSQITVETEFDNPIYETGETREYEVSI

SEQ ID NO: 77130 - protein, 796 aa, Homo sapiens
  Payload ID: 15394
  Gene Symbol: SEZ6L
  Gene Name: seizure related 6 homolog (mouse)-like
  ENSP ID: ENSP00000384733
MAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEAEAAAETSLEGGNMALAIFIPVLIISLLLGGAYIYITRCRYYSNLRLPLMYSHPYSQITVETEFDNPIYETGETREYEVSI

SEQ ID NO: 77131 - protein, 1023 aa, Homo sapiens
  Payload ID: 15394
  Gene Symbol: SEZ6L
  Gene Name: seizure related 6 homolog (mouse)-like
  Uniprot ID: Q9BYH1
  ENSP ID: ENSP00000384772
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEAEAAAETSLEGGNMALAIFIPVLIISLLLGGAYIYITRCRYYSNLRLPLMYSHPYSQITVETEFDNPIYETGETREYEVSI

SEQ ID NO: 77132 - protein, 720 aa, Homo sapiens
  Payload ID: 15394
  Gene Symbol: SEZ6L
  Gene Name: seizure related 6 homolog (mouse)-like
  ENSP ID: ENSP00000384838
MAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEAAAETSLEGGNMALAIFIPVLIISLLLGGAYIYITRCRYYSNLRLPLMYSHPYSQITVETEFDNPIYETGETREYEVSI

SEQ ID NO: 77133 - protein, 1011 aa, Homo sapiens
  Payload ID: 15394
  Gene Symbol: SEZ6L
  Gene Name: seizure related 6 homolog (mouse)-like
  ENSP ID: ENSP00000437037
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKEAAAETSLEGGNMALAIFIPVLIISLLLGGAYIYITRCRYYSNLRLPLMYSHPYSQITVETEFDNPIYETGETREYEVSI

SEQ ID NO: 77134 - protein, 1013 aa, Homo sapiens
  Payload ID: 15394
  Gene Symbol: SEZ6L
  Gene Name: seizure related 6 homolog (mouse)-like
  Uniprot ID: Q9BYH1
  ENSP ID: ENSP00000485720
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVAEAAAETSLEGGNMALAIFIPVLIISLLLGGAYIYITRCRYYSNLRLPLMYSHPYSQITVETEFDNPIYETGETREYEVSI

SEQ ID NO: 77135 - protein, 853 aa, Homo sapiens
  Payload ID: 15395
  Gene Symbol: SEZ6L2
  Gene Name: seizure related 6 homolog (mouse)-like 2
  Uniprot ID: Q6UXD5
  ENSP ID: ENSP00000310206
MGTPRAQHPPPPQLLFLILLSCPWIQGLPLKEEEILPEPGSETPTVASEALAELLHGALLRRGPEMGYLPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 77136 - protein, 910 aa, Homo sapiens
  Payload ID: 15395
  Gene Symbol: SEZ6L2
  Gene Name: seizure related 6 homolog (mouse)-like 2
  Uniprot ID: Q6UXD5
  ENSP ID: ENSP00000312550
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGNLALAILLPLGLVIVLGSGVYIYYTKLQGKSLFGFSGSHSYSPITVESDFSNPLYEAGDTREYEVSI

SEQ ID NO: 77137 - protein, 809 aa, Homo sapiens
  Payload ID: 15395
  Gene Symbol: SEZ6L2
  Gene Name: seizure related 6 homolog (mouse)-like 2
  Uniprot ID: Q6UXD5
  ENSP ID: ENSP00000319215
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 77138 - protein, 879 aa, Homo sapiens
  Payload ID: 15395
  Gene Symbol: SEZ6L2
  Gene Name: seizure related 6 homolog (mouse)-like 2
  Uniprot ID: Q6UXD5
  ENSP ID: ENSP00000439412
MGTPRAQHPPPPQLLFLILLSCPWIQGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 77139 - protein, 303 aa, Homo sapiens
  Payload ID: 15395
  Gene Symbol: SEZ6L2
  Gene Name: seizure related 6 homolog (mouse)-like 2
  ENSP ID: ENSP00000454654
  MOD_RES (1)..(1): Any amino acid
XCLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPA

SEQ ID NO: 77140 - protein, 80 aa, Homo sapiens
  Payload ID: 15395
  Gene Symbol: SEZ6L2
  Gene Name: seizure related 6 homolog (mouse)-like 2
  ENSP ID: ENSP00000458490
MGTPRAQHPPPPQLLFLILLSCPWIQGSDRDPTLATPPAGQTLAVPSLPRATEPGTGPLTTAVTPNGVRGAGPTAPELLT

SEQ ID NO: 77141 - protein, 923 aa, Homo sapiens
  Payload ID: 15395
  Gene Symbol: SEZ6L2
  Gene Name: seizure related 6 homolog (mouse)-like 2
  ENSP ID: ENSP00000481917
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 77142 - protein, 178 aa, Homo sapiens
  Payload ID: 15396
  Gene Symbol: SZT2
  Gene Name: seizure threshold 2 homolog (mouse)
  Uniprot ID: Q5T011
  ENSP ID: ENSP00000361528
MASERPEPEVEEAGQVFLLMKKDYRISRNVRLAWFLSHLHQTVQATPQEMLSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQRQGFTMLARLPSNF

SEQ ID NO: 77143 - protein, 168 aa, Homo sapiens
  Payload ID: 15396
  Gene Symbol: SZT2
  Gene Name: seizure threshold 2 homolog (mouse)
  ENSP ID: ENSP00000386070
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQMI

SEQ ID NO: 77144 - protein, 3375 aa, Homo sapiens
  Payload ID: 15396
  Gene Symbol: SZT2
  Gene Name: seizure threshold 2 homolog (mouse)
  Uniprot ID: Q5T011
  ENSP ID: ENSP00000457168
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQVLVQGCLLDPSQREVFLQQIYEQLCLFEDKVATMLQQQYDPQSQAEDQSPDSGDLLGRKVGVSMVTADLGLVSMIRQGILALQLLPSNSSAGIIVITDGVTSVPDVAVCETLLNQLRSGTVACSFVQVGGVYSYDCSFGHVPNVELMKFIAMATFGSYLSTCPEPEPGNLGLTVYHRAFLLYSFLRSGEALNPEYYCGSQHRLFNEHLVSASSNPALALRRKKHTEKEVPADLVSTVSVRLREGYSVREVTLAKGGSQLEVKLVLLWKHNMRIEYVAMAPWPLEPEGPRVTRVEVTMEGGYDILHDVSCALRQPIRSLYRTHVIRRFWNTLQSINQTDQMLAHLQSFSSVPEHFTLPDSTKSGVPLFYIPPGSTTPVLSLQPSGSDSSHAQFAAYWKPVLSMDANSWQRWLHMHRLVLILEHDTPIPKHLHTPGSNGRYSTIQCRISHSSLTSLLRDWSSFVLVEGYSYVKLLSSAPDQPPNSFYMVRIISKAPCMVLRLGFPIGTPAPARHKIVSGLREEILRLRFPHRVQSKEPTPKVKRKGLGGAGGGSSPSKSPPVLGPQQALSDRPCLVVLHKPLDKLLIRYEKLPLDYRAPFLLTLEPPGPLPLVSGRSASSSLASLSRYLYHQRWLWSVPSGLAPALPLSAIAQLLSILTEVRLSEGFHFACSGEGIINMVLELPIQNEPPGQAAAEEKHTCVVQYILFPPHSTSTKDSFSTDDDNDVEVEALEGDSELNLVTEVWVEPQYGRVGPGPGIWKHLQDLTYSEIPQALHPRDAACIGSMLSFEYLIQLCQSKEWGPLPPEPRVSDGLDQGGDTCVHEIPFHFDLMGLLPQCQQLQMFFLLLARGAEGPLLGVHGIPKEQAVGSTQATGDSAFTSLSVGLPETLKPLISAQPPQWRCYARLVNPQHVFLTFLPATFSDVQRLAACGLEGPPQEETKPKFGDWSGAPSLKDLGGTGIKATKSHVPVLSVTLASDNAQNQGELSPPFRRDLQAYAGRQASQTESADGPRTRCPVYIYSCSLEALREQMVGMQPPQAPRDLIFRTQFLDHPSPSSAWMEPRYKEAANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQVLSSLEGPPVGGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 77145 - protein, 3432 aa, Homo sapiens
  Payload ID: 15396
  Gene Symbol: SZT2
  Gene Name: seizure threshold 2 homolog (mouse)
  ENSP ID: ENSP00000489255
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQVLVQGCLLDPSQREVFLQQIYEQLCLFEDKVATMLQQQYDPQSQAEDQSPDSGDLLGRKVGVSMVTADLGLVSMIRQGILALQLLPSNSSAGIIVITDGVTSVPDVAVCETLLNQLRSGTVACSFVQVGGVYSYDCSFGHVPNVELMKFIAMATFGSYLSTCPEPEPGNLGLTVYHRAFLLYSFLRSGEALNPEYYCGSQHRLFNEHLVSASSNPALALRRKKHTEKEVPADLVSTVSVRLREGYSVREVTLAKGGSQLEVKLVLLWKHNMRIEYVAMAPWPLEPEGPRVTRVEVTMEGGYDILHDVSCALRQPIRSLYRTHVIRRFWNTLQSINQTDQMLAHLQSFSSVPEHFTLPDSTKSGVPLFYIPPGSTTPVLSLQPSGSDSSHAQFAAYWKPVLSMDANSWQRWLHMHRLVLILEHDTPIPKHLHTPGSNGRYSTIQCRISHSSLTSLLRDWSSFVLVEGYSYVKLLSSAPDQPPNSFYMVRIISKAPCMVLRLGFPIGTPAPARHKIVSGLREEILRLRFPHRVQSKEPTPKVKRKGLGGAGGGSSPSKSPPVLGPQQALSDRPCLVVLHKPLDKLLIRYEKLPLDYRAPFLLTLEPPGPLPLVSGRSASSSLASLSRYLYHQRWLWSVPSGLAPALPLSAIAQLLSILTEVRLSEGFHFACSGEGIINMVLELPIQNEPPGQAAAEEKHTCVVQYILFPPHSTSTKDSFSTDDDNDVEVEALEGDSELNLVTEVWVEPQYGRVGPGPGIWKHLQDLTYSEIPQALHPRDAACIGSMLSFEYLIQLCQSKEWGPLPPEPRVSDGLDQGGDTCVHEIPFHFDLMGLLPQCQQLQMFFLLLAREPEGVPFAEGSCPANDMVLCLLHSCLGQELSDREIPLTPVDQAAFLSEVLRRTCHVPGAEGPLLGVHGIPKEQAVGSTQATGDSAFTSLSVGLPETLKPLISAQPPQWRCYARLVNPQHVFLTFLPATFSDVQRLAACGLEGPPQEETKPKFGDWSGAPSLKDLGGTGIKATKSHVPVLSVTLASDNAQNQGELSPPFRRDLQAYAGRQASQTESADGPRTRCPVYIYSCSLEALREQMVGMQPPQAPRDLIFRTQFLDHPSPSSAWMEPRYKEAANHCALLQEHAQRCYVRGLFRSLQQAQSVTSQDLLTAVDACEELLQEIDITPFLLALCGHTWGLPHAPPSPGPLSPGPFSSSMEEGAEPRERAILASESSIETEDLSEPEFQSTRVPGIPDPGPEISLTDVCQLRGEAHGALHSVIQEKFLEISRLHFRTVPSNPHYFFYCPPSSRREDEGPRDTVDRKISDLEFSEAELMGEEGDTSACCVVTESDPELEVEYRESRESDLGPAGLDSASLSDVDTVNPDEDSFSILGGDSPTGPESFLHDLPPLFLHLTCSVRLRGQHSSVPVCSLPTCLGQVLSSLEGPPVGGRVPLRDLSVTLDVFMLTLPLEVELPTASDPQHHRSTSESSASFPRSPGQPSSLRSDDGLGPPLPPPEEERHPGLSNLATPHRLAIETTMNEIRWLLEDEMVGALRRGGIPQSPALHRAAAHIHSSPGRSTCLRQTLPLSFVFGPERSLTQFKEEFRRLHLPGHVLLEDPDSGFFFVAAGQQPGGSHGEPSSAAWAWHSHEDRAEGIEGETLTASPQAPGSPEDSEGVPLISLPRVPQGGSQPGPSRGLSLMSSQGSVDSDHLGYDGGSSGSDSEGPNDTLGEKAPFTLRTPPGPAPPQPSLSGLPGPCLPDFWLIVRVLQDRVEVYAHARSLIREDGGPGTECRHLQQLLVRRVGEICREVNQRLLLQDLHDSHVCNSLLVAESEEDLWRSETPFHSRQRAPLPSDDYAADESCAPRGYLAATMQFVPGHFSCDVVWGTVIRVHSRLKMGPSMGVSRAIQALRSVLNAFSVVNRKNMFVYQERATKAVYYLRLLETSCSDRPWKGDALPPSLALSRSQEPIYSEEASGPRSPLDMVSSRSSDAARPVGQVDRHIQLLVHGVGQAGPEITDELVRVLCRRLDEATLDVITVMLVRNCKLTPADVEFIQPPGSLPSEVLHLALPTSCRPWLPALAWYLRQNLLIFLHSPKYTDSNSRNHFQHPLPPQGGLPDLDIYLYNKPGGQGTGGKGVACITLAFVDEGGAPLSLALWPPSSPGPPDPLREEEFEQLTQVIRCPVVVDSSSAQNGAPRLRLDVWEKGNISIVQLEEKLRGAARQALADAIIELQLLPASLCTEDTPTGSLRNGSLETKSSAGRASTFPPAPVPGEPVTPPSKAGRRSFWDMLSKTECGDLGSPKTTDDIVLDRPEDTRGRRRHKTESVRTPGGAERAPGSDSGAQRQKRRTTQLEEGEVGTLHPVFARVAQRWMEFMVQIGCASVSRSSAHMVSRFLLPSILSEFTALVTSMAGDTSVRIFEQHLGSEPEIFGPCSPGQLGPSPRPAAERHLLLLGRNFLQWRRPTQQAAKAMQRFEPGGDGSSGRNAPRQRLLLLEVVDKKLQLLTYNWAPDLGAALGRALVRLVQWQNARAHLIFCLLSQKLGLFHHYGQLDFPVRDEKEPNPFLLPTMEVETLIRSASPPLSREQGRLSGSSRGGGPLPLDTFPFDEALRDITAARPSSVLGPVPRPPDPVTYHGQQFLEIKMAERRELERQMKMENLFVTWQQRSTPATMPISAGELETLKQSSRLVHYCATAMLFDPAAWLHGPPETSGPPDGQRRHRPESGSGSREAPTSCESLDVSPPGAREEPWLKELSLAFLQQYVQYLQSIGFVLVPLRPPSPARSTSRPRAMAILGTEGRGSFSCPKTKTDGSPKSTSSPVTTYHLQRALPGGIILMELAFQGCYFCVKQFALECSRIPMGQAVNSQLSMLFTEECDKVRDLMHVHSFSYDFHLRLVHQHVLGAHLVLRHGYHLTTFLRHFLAHHPDGPHFGRNHIYQGTLELPTPLIAAHQLYNYVADHASSYHMKPLRMARPGGPEHNEYALVSAWHSSGSYLDSEGLRHQDDFDVSLLVCHCAAPFEEQGEAERHVLRLQFFVVLTSQRELFPRLTADMRRFRKPPRLPPEPEAPGSSAGSPGEASGLILAPGPAPLFPPLAAEVGMARARLAQLVRLAGGHCRRDTLWKRLFLLEPPGPDRLRLGGRLALAELEELLEAVHAKSIGDIDPQLDCFLSMTVSWYQSLIKVLLSRFPQSCRHFQSPDLGTQYLVVLNQKFTDCFVLVFLDSHLGKTSLTVVFREPFPVQPQDSESPPAQLVSTYHHLESVINTACFTLWTRLL

SEQ ID NO: 77146 - protein, 794 aa, Homo sapiens
  Payload ID: 15397
  Gene Symbol: SEL1L
  Gene Name: sel-1 suppressor of lin-12-like (C. elegans)
  Uniprot ID: Q9UBV2
  ENSP ID: ENSP00000337053
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNIRDMFTQLDMDQLLGPEWDLYLMTIIALLLGTVIAYRQRQHQDMPAPRPPGPRPAPPQQEGPPEQQPPQ

SEQ ID NO: 77147 - protein, 301 aa, Homo sapiens
  Payload ID: 15397
  Gene Symbol: SEL1L
  Gene Name: sel-1 suppressor of lin-12-like (C. elegans)
  Uniprot ID: Q9UBV2
  ENSP ID: ENSP00000450709
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLVSRL

SEQ ID NO: 77148 - protein, 163 aa, Homo sapiens
  Payload ID: 15397
  Gene Symbol: SEL1L
  Gene Name: sel-1 suppressor of lin-12-like (C. elegans)
  ENSP ID: ENSP00000451144
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPDKEYDECTSDGREDGRLWCATTYDYKADEKWGFCETEEEAAKRRQMQEAE

SEQ ID NO: 77149 - protein, 688 aa, Homo sapiens
  Payload ID: 15398
  Gene Symbol: SEL1L2
  Gene Name: sel-1 suppressor of lin-12-like 2 (C. elegans)
  Uniprot ID: Q5TEA6
  ENSP ID: ENSP00000284951
MKPLSLLIEILIILGVTIKTIKAEEHNKRQKERNVTTQVSVNEIKQYLSHILEQRTSSNVINKRENLLEKKKNQRKIRIKGIQNKDILKRNKNHLQKQAEKNFTDEGDQLFKMGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVELYKGVCELGHWAEKFLTAYFAYKDGDIDSSLVQYALLAEMGYEVAQSNSAFILESKKANILEKEKMYPMALLLWNRAAIQGNAFARVKIGDYHYYGYGTKKDYQTAATHYSIAANKYHNAQAMFNLAYMYEHGLGITKDIHLARRLYDMAAQTSPDAHIPVLFAVMKLETTHLLRDILFFNFTTRWNWLKLDNTIGPHWDLFVIGLIVPGLILLLRNHHG

SEQ ID NO: 77150 - protein, 575 aa, Homo sapiens
  Payload ID: 15398
  Gene Symbol: SEL1L2
  Gene Name: sel-1 suppressor of lin-12-like 2 (C. elegans)
  Uniprot ID: Q5TEA6
  ENSP ID: ENSP00000367312
MKPLSLLIEILIILGVTIKTIKAEEHNKRQKERNVTTQVSVNEIKQYLSHILEQRTSSNVINKRENLLEKKKNQRKIRIKGIQNKDILKRNKNHLQKQAEKNFTDEGDQLFKMGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVEKRLTFLKKRRCIQWRFSYGIELPFKDIHLARRLYDMAAQTSPDAHIPVLFAVMKLETTHLLRDILFFNFTTRWNWLKLDNTIGPHWDLFVIGLIVPGLILLLRNHHG

SEQ ID NO: 77151 - protein, 178 aa, Homo sapiens
  Payload ID: 15398
  Gene Symbol: SEL1L2
  Gene Name: sel-1 suppressor of lin-12-like 2 (C. elegans)
  ENSP ID: ENSP00000394598
MKPLSLLIEILIILGVTIKTIKAEEHNKRQKERNVTTQVSVNEIKQYLSHILEQRTSSNVINKRENLLEKKKNQRKIRIKGIQNKDILKRNKNHLQKQAEKNFTDEGDQLFKMGIKVLQQSKSQKQKEEILMPTWMFLCLRSFLPGLLCSSFCPRAAYFSLSMDGLYIKSLPTFCQSS

SEQ ID NO: 77152 - protein, 44 aa, Homo sapiens
  Payload ID: 15398
  Gene Symbol: SEL1L2
  Gene Name: sel-1 suppressor of lin-12-like 2 (C. elegans)
  ENSP ID: ENSP00000418040
  MOD_RES (1)..(1): Any amino acid
XGLGLLYFHGKGVPLNYAEALKYFQKAAEKGWPDAQFQLGFMYY

SEQ ID NO: 77153 - protein, 44 aa, Homo sapiens
  Payload ID: 15398
  Gene Symbol: SEL1L2
  Gene Name: sel-1 suppressor of lin-12-like 2 (C. elegans)
  ENSP ID: ENSP00000420372
MGIKVLQQSKSQKQKEEAYLLFAKAADMGNLKAMEKMADALLFG

SEQ ID NO: 77154 - protein, 1097 aa, Homo sapiens
  Payload ID: 15399
  Gene Symbol: SEL1L3
  Gene Name: sel-1 suppressor of lin-12-like 3 (C. elegans)
  Uniprot ID: Q68CR1
  ENSP ID: ENSP00000264868
MAPRPKKQPDKNPLHGRELNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 77155 - protein, 1132 aa, Homo sapiens
  Payload ID: 15399
  Gene Symbol: SEL1L3
  Gene Name: sel-1 suppressor of lin-12-like 3 (C. elegans)
  Uniprot ID: Q68CR1
  ENSP ID: ENSP00000382767
MQRRGAGLGWPRQQQQQPPPLAVGPRAAAMVPSGGVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 77156 - protein, 35 aa, Homo sapiens
  Payload ID: 15399
  Gene Symbol: SEL1L3
  Gene Name: sel-1 suppressor of lin-12-like 3 (C. elegans)
  ENSP ID: ENSP00000420951
MVYRDDYFIRHSISVSAVIVRAWITHKYSGRDWNV

SEQ ID NO: 77157 - protein, 62 aa, Homo sapiens
  Payload ID: 15399
  Gene Symbol: SEL1L3
  Gene Name: sel-1 suppressor of lin-12-like 3 (C. elegans)
  ENSP ID: ENSP00000421567
MVYRDDYFIRHSISVSAVIVRAWITHKYSGRDWNVKWEENLLHAVAKNYTLLQTIPPFERPF

SEQ ID NO: 77158 - protein, 130 aa, Homo sapiens
  Payload ID: 15399
  Gene Symbol: SEL1L3
  Gene Name: sel-1 suppressor of lin-12-like 3 (C. elegans)
  ENSP ID: ENSP00000421701
  MOD_RES (1)..(1): Any amino acid
XYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSEFCLCVPENTAPKLLAA

SEQ ID NO: 77159 - protein, 75 aa, Homo sapiens
  Payload ID: 15399
  Gene Symbol: SEL1L3
  Gene Name: sel-1 suppressor of lin-12-like 3 (C. elegans)
  ENSP ID: ENSP00000423743
MVYRDDYFIRHSISVSAVIVRAWITHKYSGRDWNVKWEENLLHAVAKNYTLLQTIPPFERPFKDHQVCLEWNMGY

SEQ ID NO: 77160 - protein, 77 aa, Homo sapiens
  Payload ID: 15399
  Gene Symbol: SEL1L3
  Gene Name: sel-1 suppressor of lin-12-like 3 (C. elegans)
  ENSP ID: ENSP00000424564
TLAGEYFHKAAQGGHMEGTLWCSLYYITGNLETFPRDPEKAVVKSLSTSVLGHPHTDTLALQKIVLHNTFGFKFNLT

SEQ ID NO: 77161 - protein, 979 aa, Homo sapiens
  Payload ID: 15399
  Gene Symbol: SEL1L3
  Gene Name: sel-1 suppressor of lin-12-like 3 (C. elegans)
  Uniprot ID: Q68CR1
  ENSP ID: ENSP00000425438
MVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 77162 - protein, 130 aa, Homo sapiens
  Payload ID: 15399
  Gene Symbol: SEL1L3
  Gene Name: sel-1 suppressor of lin-12-like 3 (C. elegans)
  ENSP ID: ENSP00000426050
TNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERSTFWEPFCYPY

SEQ ID NO: 77163 - protein, 610 aa, Homo sapiens
  Payload ID: 15400
  Gene Symbol: SELE
  Gene Name: selectin E
  Uniprot ID: P16581
  ENSP ID: ENSP00000331736
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 77164 - protein, 484 aa, Homo sapiens
  Payload ID: 15400
  Gene Symbol: SELE
  Gene Name: selectin E
  ENSP ID: ENSP00000356748
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 77165 - protein, 485 aa, Homo sapiens
  Payload ID: 15400
  Gene Symbol: SELE
  Gene Name: selectin E
  ENSP ID: ENSP00000356749
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQMVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 77166 - protein, 547 aa, Homo sapiens
  Payload ID: 15400
  Gene Symbol: SELE
  Gene Name: selectin E
  ENSP ID: ENSP00000356750
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 77167 - protein, 547 aa, Homo sapiens
  Payload ID: 15400
  Gene Symbol: SELE
  Gene Name: selectin E
  ENSP ID: ENSP00000356751
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 77168 - protein, 12 aa, Homo sapiens
  Payload ID: 15400
  Gene Symbol: SELE
  Gene Name: selectin E
  ENSP ID: ENSP00000476784
MIASQFLSALTL

SEQ ID NO: 77169 - protein, 385 aa, Homo sapiens
  Payload ID: 15401
  Gene Symbol: SELL
  Gene Name: selectin L
  Uniprot ID: P14151
  ENSP ID: ENSP00000236147
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGLAFIIWLARRLKKGKKSKRSMNDPY

SEQ ID NO: 77170 - protein, 830 aa, Homo sapiens
  Payload ID: 15402
  Gene Symbol: SELP
  Gene Name: selectin P (granule membrane protein 140kDa, antigen CD62)
  Uniprot ID: P16109
  ENSP ID: ENSP00000263686
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 77171 - protein, 768 aa, Homo sapiens
  Payload ID: 15402
  Gene Symbol: SELP
  Gene Name: selectin P (granule membrane protein 140kDa, antigen CD62)
  ENSP ID: ENSP00000356760
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 77172 - protein, 768 aa, Homo sapiens
  Payload ID: 15402
  Gene Symbol: SELP
  Gene Name: selectin P (granule membrane protein 140kDa, antigen CD62)
  ENSP ID: ENSP00000356762
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 77173 - protein, 444 aa, Homo sapiens
  Payload ID: 15402
  Gene Symbol: SELP
  Gene Name: selectin P (granule membrane protein 140kDa, antigen CD62)
  ENSP ID: ENSP00000356769
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCE

SEQ ID NO: 77174 - protein, 789 aa, Homo sapiens
  Payload ID: 15402
  Gene Symbol: SELP
  Gene Name: selectin P (granule membrane protein 140kDa, antigen CD62)
  ENSP ID: ENSP00000391694
ANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQDDGKCPLNPHSHLGTYGVFTNAAFDPSP

SEQ ID NO: 77175 - protein, 646 aa, Homo sapiens
  Payload ID: 15402
  Gene Symbol: SELP
  Gene Name: selectin P (granule membrane protein 140kDa, antigen CD62)
  ENSP ID: ENSP00000399368
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQGKSIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 77176 - protein, 428 aa, Homo sapiens
  Payload ID: 15403
  Gene Symbol: SELPLG
  Gene Name: selectin P ligand
  Uniprot ID: Q14242
  ENSP ID: ENSP00000228463
MAVGASGLEGDKMAGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 77177 - protein, 402 aa, Homo sapiens
  Payload ID: 15403
  Gene Symbol: SELPLG
  Gene Name: selectin P ligand
  ENSP ID: ENSP00000373614
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 77178 - protein, 412 aa, Homo sapiens
  Payload ID: 15403
  Gene Symbol: SELPLG
  Gene Name: selectin P ligand
  Uniprot ID: Q14242
  ENSP ID: ENSP00000447752
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 77179 - protein, 472 aa, Homo sapiens
  Payload ID: 15404
  Gene Symbol: SELENBP1
  Gene Name: selenium binding protein 1
  Uniprot ID: Q13228
  ENSP ID: ENSP00000357861
MATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 77180 - protein, 47 aa, Homo sapiens
  Payload ID: 15404
  Gene Symbol: SELENBP1
  Gene Name: selenium binding protein 1
  ENSP ID: ENSP00000390433
MATKCGNCGPGYSTPLEAMKGHPPAAHAQPEGRAASLRMEHLQQLLR

SEQ ID NO: 77181 - protein, 123 aa, Homo sapiens
  Payload ID: 15404
  Gene Symbol: SELENBP1
  Gene Name: selenium binding protein 1
  ENSP ID: ENSP00000395637
MATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKACH

SEQ ID NO: 77182 - protein, 305 aa, Homo sapiens
  Payload ID: 15404
  Gene Symbol: SELENBP1
  Gene Name: selenium binding protein 1
  ENSP ID: ENSP00000396209
  MOD_RES (1)..(1): Any amino acid
XAERAEGAFTLQSVAQPMRPIASTATKCGNCGPGYSTPLEAMKGPREEIVYLPCIYRNTGTEAPDYLATVDVDPKSPQYCQVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPR

SEQ ID NO: 77183 - protein, 514 aa, Homo sapiens
  Payload ID: 15404
  Gene Symbol: SELENBP1
  Gene Name: selenium binding protein 1
  Uniprot ID: Q13228
  ENSP ID: ENSP00000397261
MRLEWGPRPAALPWPAGMCAAERAEGAFTLQSVAQPMRPIASTATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 77184 - protein, 80 aa, Homo sapiens
  Payload ID: 15404
  Gene Symbol: SELENBP1
  Gene Name: selenium binding protein 1
  ENSP ID: ENSP00000400841
MKGPREEIVYLPCIYRNTGTEAPDYLATVDVDPKSPQYCQVIHRLPMPNLKDELHHSGWNTCSSCFGDSTKSRTKLVLPS

SEQ ID NO: 77185 - protein, 123 aa, Homo sapiens; identical to SEQ ID NO: 77181
  Payload ID: 15404
  Gene Symbol: SELENBP1
  Gene Name: selenium binding protein 1
  ENSP ID: ENSP00000402531

SEQ ID NO: 77186 - protein, 295 aa, Homo sapiens
  Payload ID: 15404
  Gene Symbol: SELENBP1
  Gene Name: selenium binding protein 1
  ENSP ID: ENSP00000406222
MATKCGNCGPGYSTPLEAMKGTEAPDYLATVDVDPKSPQYCQVIHRLPMPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLIT

SEQ ID NO: 77187 - protein, 123 aa, Homo sapiens; identical to SEQ ID NO: 77181
  Payload ID: 15404
  Gene Symbol: SELENBP1
  Gene Name: selenium binding protein 1
  ENSP ID: ENSP00000412816

SEQ ID NO: 77188 - protein, 410 aa, Homo sapiens
  Payload ID: 15404
  Gene Symbol: SELENBP1
  Gene Name: selenium binding protein 1
  Uniprot ID: Q13228
  ENSP ID: ENSP00000413960
MATKCGNCGPGYSTPLEAMKGPREEIVYLPCIYRNTGTEAPDYLATVDVDPKSPQYCQVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 77189 - protein, 165 aa, Homo sapiens
  Payload ID: 15404
  Gene Symbol: SELENBP1
  Gene Name: selenium binding protein 1
  ENSP ID: ENSP00000416206
MRLEWGPRPAALPWPAGMCAAERAEGAFTLQSVAQPMRPIASTATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKACH

SEQ ID NO: 77190 - protein, 453 aa, Homo sapiens
  Payload ID: 15405
  Gene Symbol: SCLY
  Gene Name: selenocysteine lyase
  ENSP ID: ENSP00000254663
MPGSSGAGMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 77191 - protein, 317 aa, Homo sapiens
  Payload ID: 15405
  Gene Symbol: SCLY
  Gene Name: selenocysteine lyase
  Uniprot ID: Q96I15
  ENSP ID: ENSP00000387162
MEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKVSPGELEEMS

SEQ ID NO: 77192 - protein, 73 aa, Homo sapiens
  Payload ID: 15405
  Gene Symbol: SCLY
  Gene Name: selenocysteine lyase
  ENSP ID: ENSP00000391361
MEAAVAPGRDAPAPAASQPSGCGKHNSPERKVYMDYNATTPLEPEVIQAMTKAMWEAWGNPSSPYSAERPRIL

SEQ ID NO: 77193 - protein, 71 aa, Homo sapiens
  Payload ID: 15405
  Gene Symbol: SCLY
  Gene Name: selenocysteine lyase
  ENSP ID: ENSP00000392517
MEAAVAPGRDAPAPAASQPSGCGKHNSPERKVYMDYNATTPLEPEVIQAMTKAMWEAWGNPSSPYSAAYSM

SEQ ID NO: 77194 - protein, 122 aa, Homo sapiens
  Payload ID: 15405
  Gene Symbol: SCLY
  Gene Name: selenocysteine lyase
  ENSP ID: ENSP00000401401
  MOD_RES (1)..(1): Any amino acid
XFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGDGPSPWSFRV

SEQ ID NO: 77195 - protein, 168 aa, Homo sapiens
  Payload ID: 15405
  Gene Symbol: SCLY
  Gene Name: selenocysteine lyase
  ENSP ID: ENSP00000402078
  MOD_RES (1)..(1): Any amino acid
XVEEQVAAVTFVPVSKVSGQAEVDDILAAVRPTTRLVTIMLANNETGIVMPVPEISQRIKALNQERVAAGLPPILVHTDAAQALGKQRVDVEDLGVDFLTIVGHKGRAACHRAEHESLAPALPPRLGFHPAPKAFVTLRVKRGGTQRRHKEAAGLCIAEHFSCVPLST

SEQ ID NO: 77196 - protein, 251 aa, Homo sapiens
  Payload ID: 15405
  Gene Symbol: SCLY
  Gene Name: selenocysteine lyase
  ENSP ID: ENSP00000404444
  MOD_RES (1)..(1): Any amino acid
XEQVAAVTFVPVSKVSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAEFGQKRIHLNSQFPGTQRLPNTCNFSIRGPRLQGHVVLAQCRVLMASVGAACHSDHGDQGFFSQNALAFGHTSHVDICIGVIFSGITFLMCGFTVQGTT

SEQ ID NO: 77197 - protein, 151 aa, Homo sapiens
  Payload ID: 15405
  Gene Symbol: SCLY
  Gene Name: selenocysteine lyase
  ENSP ID: ENSP00000404473
APAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAGE

SEQ ID NO: 77198 - protein, 59 aa, Homo sapiens
  Payload ID: 15405
  Gene Symbol: SCLY
  Gene Name: selenocysteine lyase
  ENSP ID: ENSP00000405907
  MOD_RES (1)..(1): Any amino acid
XGYLPSSCTRMLHRPWGSSAWMWRTWAWTSLQSWGTRTENTPMIAGLGKVSPGELEEMS

SEQ ID NO: 77199 - protein, 109 aa, Homo sapiens
  Payload ID: 15405
  Gene Symbol: SCLY
  Gene Name: selenocysteine lyase
  ENSP ID: ENSP00000406710
DAPAPAASQPSGCGKHNSPERCAPLGQGWGAAGACRRLSRAGGRRGLPACGRSRVGRPARGCPRGRPKSGMRASRRSGCELWPRKGPRRGKFIWTIMQRLPWSQKLSRP

SEQ ID NO: 77200 - protein, 241 aa, Homo sapiens
  Payload ID: 15405
  Gene Symbol: SCLY
  Gene Name: selenocysteine lyase
  ENSP ID: ENSP00000414053
VSGQAEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDHSSCSSVSPSPGRPQCC

SEQ ID NO: 77201 - protein, 170 aa, Homo sapiens
  Payload ID: 15405
  Gene Symbol: SCLY
  Gene Name: selenocysteine lyase
  ENSP ID: ENSP00000414165
MPGSSGAGMEAAVAPGRDAPAPAASQPSGCGKHNSPERKVYMDYNATTPLEPEVIQAMTKAMWEAWGNPSSPYSAAVTFVPVSKVSGQAEVDDILAAVRPTTRLVTIMLANNETGIVMPVPEISQRIKALNQERVAAGLPPILVHTDAAQALGKQRVDVEDLGVDFLTIV

SEQ ID NO: 77202 - protein, 195 aa, Homo sapiens
  Payload ID: 15405
  Gene Symbol: SCLY
  Gene Name: selenocysteine lyase
  ENSP ID: ENSP00000416344
  MOD_RES (1)..(1): Any amino acid
XMEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTEAAELVTQNCEAYEAHMRDVRDYLEERLEAEFGQKRIHLNSQFPGTQRLPNTCNFSIRGPRLQGHVVLAQCRVLMASVGAACHSDHGDQPSPVL

SEQ ID NO: 77203 - protein, 321 aa, Homo sapiens
  Payload ID: 15406
  Gene Symbol: SEPHS1
  Gene Name: selenophosphate synthetase 1
  Uniprot ID: P49903
  ENSP ID: ENSP00000367877
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTGGLLICLPREQAARFCAEIKSPKYGEGHQAWIIGIVEKGNRTARIIDKPRIIEVAPQVATQNVNPTPGATS

SEQ ID NO: 77204 - protein, 392 aa, Homo sapiens
  Payload ID: 15406
  Gene Symbol: SEPHS1
  Gene Name: selenophosphate synthetase 1
  Uniprot ID: P49903
  ENSP ID: ENSP00000367893
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 77205 - protein, 91 aa, Homo sapiens
  Payload ID: 15406
  Gene Symbol: SEPHS1
  Gene Name: selenophosphate synthetase 1
  ENSP ID: ENSP00000400418
MDTCVIPLRHGGLSLVQTTDYIYPIVDDPYMMGRIACANVLSDLYAMGVTECDNMLMLLGVSNKMTDRERDKVMPLIIQGFKDAAEEAGTS

SEQ ID NO: 77206 - protein, 166 aa, Homo sapiens
  Payload ID: 15406
  Gene Symbol: SEPHS1
  Gene Name: selenophosphate synthetase 1
  ENSP ID: ENSP00000401732
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVL

SEQ ID NO: 77207 - protein, 325 aa, Homo sapiens
  Payload ID: 15406
  Gene Symbol: SEPHS1
  Gene Name: selenophosphate synthetase 1
  Uniprot ID: P49903
  ENSP ID: ENSP00000441119
MDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 77208 - protein, 448 aa, Homo sapiens
  Payload ID: 15407
  Gene Symbol: SEPHS2
  Gene Name: selenophosphate synthetase 2
  ENSP ID: ENSP00000418669
  MOD_RES (60)..(60): Selenocysteine
MAEASATGACGEAMAAAEGSSGPAGLTLGRSFSNYRPFEPQALGLSPSWRLTGFSGMKGXGCKVPQEALLKLLAGLTRPDVRPPLGRGLVGGQEEASQEAGLPAGAGPSPTFPALGIGMDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSS

SEQ ID NO: 77209 - protein, 72 aa, Homo sapiens
  Payload ID: 15408
  Gene Symbol:
  Gene Name: selenoprotein K [Source:EntrezGene
  Acc:58515]
  ENSP ID: ENSP00000417272
MVYISNGQVLDSRSQSPWRLSLITDFFWGIAEFVVLFFKTLLQQDVKKRRSYGNSSDSRYDDGRGKPSPKNG

SEQ ID NO: 77210 - protein, 94 aa, Homo sapiens
  Payload ID: 15408
  Gene Symbol:
  Gene Name: selenoprotein K [Source:EntrezGene
  Acc:58515]
  ENSP ID: ENSP00000418813
  MOD_RES (92)..(92): Selenocysteine
MVYISNGQVLDSRSQSPWRLSLITDFFWGIAEFVVLFFKTLLQQDVKKRRSYGNSSDSRYDDGRGPPGNPPRRMGRINHLRGPSPPPMAGGXGR

SEQ ID NO: 77211 - protein, 93 aa, Homo sapiens
  Payload ID: 15408
  Gene Symbol:
  Gene Name: selenoprotein K [Source:EntrezGene
  Acc:58515]
  ENSP ID: ENSP00000443164
MVYISNGQVLDSRSQSPWRLSLITDFFWGIAEFVVLFFKTLLQQDVKKRRSYGNSSDSRYDDGRGPPGNPPRRMGRINHLRGPSPPPMAGGGR

SEQ ID NO: 77212 - protein, 145 aa, Homo sapiens
  Payload ID: 15409
  Gene Symbol:
  Gene Name: selenoprotein M [Source:EntrezGene
  Acc:140606]
  ENSP ID: ENSP00000383155
  MOD_RES (48)..(48): Selenocysteine
MSLLLPPLALLLLLAALVAPATAATAYRPDWNRLSGLTRARVETCGGXQLNRLKEVKAFVTQDIPFYHNLVMKHLPGADPELVLLGRRYEELERIPLSEMTREEINALVQELGFYRKAAPDAQVPPEYVWAPAKPPEETSDHADL

SEQ ID NO: 77213 - protein, 145 aa, Homo sapiens; identical to SEQ ID NO: 77212
  Payload ID: 15409
  Gene Symbol:
  Gene Name: selenoprotein M [Source:EntrezGene
  Acc:140606]
  ENSP ID: ENSP00000384564
  MOD_RES (48)..(48): Selenocysteine

SEQ ID NO: 77214 - protein, 144 aa, Homo sapiens
  Payload ID: 15409
  Gene Symbol:
  Gene Name: selenoprotein M [Source:EntrezGene
  Acc:140606]
  ENSP ID: ENSP00000480176
MSLLLPPLALLLLLAALVAPATAATAYRPDWNRLSGLTRARVETCGGQLNRLKEVKAFVTQDIPFYHNLVMKHLPGADPELVLLGRRYEELERIPLSEMTREEINALVQELGFYRKAAPDAQVPPEYVWAPAKPPEETSDHADL

SEQ ID NO: 77215 - protein, 556 aa, Homo sapiens
  Payload ID: 15410
  Gene Symbol: SEPN1
  Gene Name: selenoprotein N, 1
  ENSP ID: ENSP00000346109
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCHCSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 77216 - protein, 590 aa, Homo sapiens
  Payload ID: 15410
  Gene Symbol: SEPN1
  Gene Name: selenoprotein N, 1
  Uniprot ID: Q9NZV5
  ENSP ID: ENSP00000355141
  MOD_RES (127)..(127): Selenocysteine
  MOD_RES (462)..(462): Selenocysteine
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSCSVTQTGVQWCSHSSLQPQLPWLNXSSCLSLLRSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCXGSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 77217 - protein, 556 aa, Homo sapiens
  Payload ID: 15410
  Gene Symbol: SEPN1
  Gene Name: selenoprotein N, 1
  Uniprot ID: Q9NZV5
  ENSP ID: ENSP00000363434
  MOD_RES (428)..(428): Selenocysteine
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCXGSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 77218 - protein, 66 aa, Homo sapiens
  Payload ID: 15410
  Gene Symbol: SEPN1
  Gene Name: selenoprotein N, 1
  ENSP ID: ENSP00000487549
MMICLPNGTVVHHINANYFLDITSVKPEEIESNLFSFSSTFEDPSTATYMQFLKEGLRRGLPLLQP

SEQ ID NO: 77219 - protein, 669 aa, Homo sapiens
  Payload ID: 15411
  Gene Symbol:
  Gene Name: selenoprotein O [Source:EntrezGene
  Acc:83642]
  ENSP ID: ENSP00000370288
  MOD_RES (667)..(667): Selenocysteine
MAVYRAALGASLAAARLLPLGRCSPSPAPRSTLSGAAMEPAPRWLAGLRFDNRALRALPVEAPPPGPEGAPSAPRPVPGACFTRVQPTPLRQPRLVALSEPALALLGLGAPPAREAEAEAALFFSGNALLPGAEPAAHCYCGHQFGQFAGQLGDGAAMYLGEVCTATGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVTXSS

SEQ ID NO: 77220 - protein, 668 aa, Homo sapiens
  Payload ID: 15411
  Gene Symbol:
  Gene Name: selenoprotein O [Source:EntrezGene
  Acc:83642]
  ENSP ID: ENSP00000483593
MAVYRAALGASLAAARLLPLGRCSPSPAPRSTLSGAAMEPAPRWLAGLRFDNRALRALPVEAPPPGPEGAPSAPRPVPGACFTRVQPTPLRQPRLVALSEPALALLGLGAPPAREAEAEAALFFSGNALLPGAEPAAHCYCGHQFGQFAGQLGDGAAMYLGEVCTATGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVTSS

SEQ ID NO: 77221 - protein, 381 aa, Homo sapiens
  Payload ID: 15412
  Gene Symbol: SEPP1
  Gene Name: selenoprotein P, plasma, 1
  Uniprot ID: P49908
  ENSP ID: ENSP00000420939
  MOD_RES (59)..(59): Selenocysteine
  MOD_RES (300)..(300): Selenocysteine
  MOD_RES (318)..(318): Selenocysteine
  MOD_RES (330)..(330): Selenocysteine
  MOD_RES (345)..(345): Selenocysteine
  MOD_RES (352)..(352): Selenocysteine
  MOD_RES (367)..(367): Selenocysteine
  MOD_RES (369)..(369): Selenocysteine
  MOD_RES (376)..(376): Selenocysteine
  MOD_RES (378)..(378): Selenocysteine
MWRSLGLALALCLLPSGGTESQDQSSLCKQPPAWSIRDQDPMLNSNGSVTVVALLQASXYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEHHHNHGHQHLGSSELSENQQPGAPNAPTHPAPPGLHHHHKHKGQHRQGHPENRDMPASEDLQDLQKKLCRKRCINQLLCKLPTDSELAPRSXCCHCRHLIFEKTGSAITXQCKENLPSLCSXQGLRAEENITESCQXRLPPAAXQISQQLIPTEASASXRXKNQAKKXEXPSN

SEQ ID NO: 77222 - protein, 310 aa, Homo sapiens
  Payload ID: 15412
  Gene Symbol: SEPP1
  Gene Name: selenoprotein P, plasma, 1
  ENSP ID: ENSP00000421626
  MOD_RES (59)..(59): Selenocysteine
  MOD_RES (300)..(300): Selenocysteine
MWRSLGLALALCLLPSGGTESQDQSSLCKQPPAWSIRDQDPMLNSNGSVTVVALLQASXYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEHHHNHGHQHLGSSELSENQQPGAPNAPTHPAPPGLHHHHKHKGQHRQGHPENRDMPASEDLQDLQKKLCRKRCINQLLCKLPTDSELAPRSXCCHCRHLIFE

SEQ ID NO: 77223 - protein, 381 aa, Homo sapiens; identical to SEQ ID NO: 77221
  Payload ID: 15412
  Gene Symbol: SEPP1
  Gene Name: selenoprotein P, plasma, 1
  Uniprot ID: P49908
  ENSP ID: ENSP00000425915
  MOD_RES (59)..(59): Selenocysteine
  MOD_RES (300)..(300): Selenocysteine
  MOD_RES (318)..(318): Selenocysteine
  MOD_RES (330)..(330): Selenocysteine
  MOD_RES (345)..(345): Selenocysteine
  MOD_RES (352)..(352): Selenocysteine
  MOD_RES (367)..(367): Selenocysteine
  MOD_RES (369)..(369): Selenocysteine
  MOD_RES (376)..(376): Selenocysteine
  MOD_RES (378)..(378): Selenocysteine

SEQ ID NO: 77224 - protein, 209 aa, Homo sapiens
  Payload ID: 15412
  Gene Symbol: SEPP1
  Gene Name: selenoprotein P, plasma, 1
  ENSP ID: ENSP00000427414
  MOD_RES (59)..(59): Selenocysteine
MWRSLGLALALCLLPSGGTESQDQSSLCKQPPAWSIRDQDPMLNSNGSVTVVALLQASXYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEH

SEQ ID NO: 77225 - protein, 381 aa, Homo sapiens; identical to SEQ ID NO: 77221
  Payload ID: 15412
  Gene Symbol: SEPP1
  Gene Name: selenoprotein P, plasma, 1
  Uniprot ID: P49908
  ENSP ID: ENSP00000427671
  MOD_RES (59)..(59): Selenocysteine
  MOD_RES (300)..(300): Selenocysteine
  MOD_RES (318)..(318): Selenocysteine
  MOD_RES (330)..(330): Selenocysteine
  MOD_RES (345)..(345): Selenocysteine
  MOD_RES (352)..(352): Selenocysteine
  MOD_RES (367)..(367): Selenocysteine
  MOD_RES (369)..(369): Selenocysteine
  MOD_RES (376)..(376): Selenocysteine
  MOD_RES (378)..(378): Selenocysteine

SEQ ID NO: 77226 - protein, 171 aa, Homo sapiens
  Payload ID: 15412
  Gene Symbol: SEPP1
  Gene Name: selenoprotein P, plasma, 1
  ENSP ID: ENSP00000473340
  MOD_RES (59)..(59): Selenocysteine
MWRSLGLALALCLLPSGGTESQDQSSLCKQPPAWSIRDQDPMLNSNGSVTVVALLQASXYLCILQASKLSKMKTFVNVYLWLLWIKQLKLHRLITIMSIITIMDISTLAAVSFQRISNQEHQMLLLILLLQAFITTISTRVSIGRVTQRTEICQQVKIYKIYKRSSVERDV

SEQ ID NO: 77227 - protein, 45 aa, Homo sapiens
  Payload ID: 15413
  Gene Symbol:
  Gene Name: selenoprotein T [Source:EntrezGene
  Acc:51714]
  ENSP ID: ENSP00000417703
MRLLLLLLVAASAMVRSEASANLGGVPSKRLKMQYATGPLLKFQI

SEQ ID NO: 77228 - protein, 137 aa, Homo sapiens
  Payload ID: 15413
  Gene Symbol:
  Gene Name: selenoprotein T [Source:EntrezGene
  Acc:51714]
  ENSP ID: ENSP00000417762
MRVISQRYPDIRIEGENYLPQPIYRHIASFLSVFKLVLIGLIIVGKDPFAFFGMQAPSIWQWGQENKVYACMMVFFLSNMIENQCMSTGAFEITLNDVPVWSKLESGHLPSMQQLVQILDNEMKLNVHMDSIPHHRS

SEQ ID NO: 77229 - protein, 137 aa, Homo sapiens; identical to SEQ ID NO: 77228
  Payload ID: 15413
  Gene Symbol:
  Gene Name: selenoprotein T [Source:EntrezGene
  Acc:51714]
  ENSP ID: ENSP00000417932

SEQ ID NO: 77230 - protein, 195 aa, Homo sapiens
  Payload ID: 15413
  Gene Symbol:
  Gene Name: selenoprotein T [Source:EntrezGene
  Acc:51714]
  ENSP ID: ENSP00000418910
  MOD_RES (49)..(49): Selenocysteine
MRLLLLLLVAASAMVRSEASANLGGVPSKRLKMQYATGPLLKFQICVSXGYRRVFEEYMRVISQRYPDIRIEGENYLPQPIYRHIASFLSVFKLVLIGLIIVGKDPFAFFGMQAPSIWQWGQENKVYACMMVFFLSNMIENQCMSTGAFEITLNDVPVWSKLESGHLPSMQQLVQILDNEMKLNVHMDSIPHHRS

SEQ ID NO: 77231 - protein, 137 aa, Homo sapiens; identical to SEQ ID NO: 77228
  Payload ID: 15413
  Gene Symbol:
  Gene Name: selenoprotein T [Source:EntrezGene
  Acc:51714]
  ENSP ID: ENSP00000420390

SEQ ID NO: 77232 - protein, 195 aa, Homo sapiens [sequence omitted]

SEQ ID NO: 77233 - protein, 346 aa, Homo sapiens
  Payload ID: 15414
  Gene Symbol:
  Gene Name: selenoprotein V [Source:EntrezGene
  Acc:348303]
  ENSP ID: ENSP00000333956
  MOD_RES (273)..(273): Selenocysteine
MNNQARTPAPSSARTSTSVRASTPTRTPTPLRTPTPVRTRTPIRTLTPVLTPSPAGTSPLVLTPAPAQIPTLVPTPALARIPRLVPPPAPAWIPTPVPTPVPVRNPTPVPTPARTLTPPVRVPAPAPAQLLAGIRAALPVLDSYLAPALPLDPPPEPAPELPLLPEEDPEPAPSLKLIPSVSSEAGPAPGPLPTRTPLAANSPGPTLDFTFRADPSAIGLADPPIPSPVPSPILGTIPSAISLQNCTETFPSSSENFALDKRVLIRVTYCGLXSYSLRYILLKKSLEQQFPNHLLFEEDRAAQATGEFEVFVNGRLVHSKKRGDGFVNESRLQKIVSVIDEEIKKR

SEQ ID NO: 77234 - protein, 345 aa, Homo sapiens
  Payload ID: 15414
  Gene Symbol:
  Gene Name: selenoprotein V [Source:EntrezGene
  Acc:348303]
  ENSP ID: ENSP00000412508
MNNQARTPAPSSARTSTSVRASTPTRTPTPLRTPTPVRTRTPIRTLTPVLTPSPAGTSPLVLTPAPAQIPTLVPTPALARIPRLVPPPAPAWIPTPVPTPVPVRNPTPVPTPARTLTPPVRVPAPAPAQLLAGIRAALPVLDSYLAPALPLDPPPEPAPELPLLPEEDPEPAPSLKLIPSVSSEAGPAPGPLPTRTPLAANSPGPTLDFTFRADPSAIGLADPPIPSPVPSPILGTIPSAISLQNCTETFPSSSENFALDKRVLIRVTYCGLSYSLRYILLKKSLEQQFPNHLLFEEDRAAQATGEFEVFVNGRLVHSKKRGDGFVNESRLQKIVSVIDEEIKKR

SEQ ID NO: 77235 - protein, 73 aa, Homo sapiens
  Payload ID: 15414
  Gene Symbol:
  Gene Name: selenoprotein V [Source:EntrezGene
  Acc:348303]
  ENSP ID: ENSP00000470671
  MOD_RES (1)..(1): Any amino acid
XSPGPTLDFTFRADPSAIGLADPPIPSPVPSPILGTIPSAISLQNCTETFPSSSENFALDKRVLIRVTYCTFY

SEQ ID NO: 77236 - protein, 346 aa, Homo sapiens [sequence omitted]

SEQ ID NO: 77237 - protein, 88 aa, Homo sapiens [sequence omitted]

SEQ ID NO: 77238 - protein, 85 aa, Homo sapiens
  Payload ID: 15415
  Gene Symbol: SEPW1
  Gene Name: selenoprotein W, 1
  ENSP ID: ENSP00000470135
  MOD_RES (19)..(19): Selenocysteine
  MOD_RES (52)..(52): Selenocysteine
  MOD_RES (84)..(84): Selenocysteine
MWQPRAMALAVRVVYCGAXGYKSKYLQLKKKLEDEFPGRLDIVSLGMGRKTXAQPLCRSVRPGWHCRGVSAARELPRPPGSLKXW

SEQ ID NO: 77239 - protein, 87 aa, Homo sapiens
  Payload ID: 15415
  Gene Symbol: SEPW1
  Gene Name: selenoprotein W, 1
  Uniprot ID: P63302
  ENSP ID: ENSP00000470941
  MOD_RES (13)..(13): Selenocysteine
MALAVRVVYCGAXGYKSKYLQLKKKLEDEFPGRLDICGEGTPQATGFFEVMVAGKLIHSKKKGDGYVDTESKFLKLVAAIKAALAQG

SEQ ID NO: 77240 - protein, 87 aa, Homo sapiens; identical to SEQ ID NO: 77239
  Payload ID: 15415
  Gene Symbol: SEPW1
  Gene Name: selenoprotein W, 1
  Uniprot ID: P63302
  ENSP ID: ENSP00000471149
  MOD_RES (13)..(13): Selenocysteine

SEQ ID NO: 77241 - protein, 87 aa, Homo sapiens; identical to SEQ ID NO: 77239
  Payload ID: 15415
  Gene Symbol: SEPW1
  Gene Name: selenoprotein W, 1
  Uniprot ID: P63302
  ENSP ID: ENSP00000473185
  MOD_RES (13)..(13): Selenocysteine

SEQ ID NO: 77242 - protein, 86 aa, Homo sapiens
  Payload ID: 15415
  Gene Symbol: SEPW1
  Gene Name: selenoprotein W, 1
  ENSP ID: ENSP00000480640
MALAVRVVYCGAGYKSKYLQLKKKLEDEFPGRLDICGEGTPQATGFFEVMVAGKLIHSKKKGDGYVDTESKFLKLVAAIKAALAQG

SEQ ID NO: 77243 - protein, 771 aa, Homo sapiens [sequence omitted]

SEQ ID NO: 77244 - protein, 149 aa, Homo sapiens
  Payload ID: 15416
  Gene Symbol: SEMA3A
  Gene Name: sema domain, immunoglobulin domain (Ig), short basic domain, secreted, (semaphorin) 3A
  ENSP ID: ENSP00000391900
MGWLTRIVCLFWGVLLTARANYQNGKNNVPRLKLSYKEMLESNNVITFNGLANSSSYHTFLLDEERSRLYVGAKDHIFSFDLVNIKDFQKIVWPVSYTRRDECKWAGKDILKECANFIKVLKAYNQTHLYACGTGAFHPICTYIEIGHH

SEQ ID NO: 77245 - protein, 37 aa, Homo sapiens
  Payload ID: 15416
  Gene Symbol: SEMA3A
  Gene Name: sema domain, immunoglobulin domain (Ig), short basic domain, secreted, (semaphorin) 3A
  ENSP ID: ENSP00000402093
MGWLTRIVCLFWGVLLTARANYQNGKNNVPRLKLSYK

SEQ ID NO: 77246 - protein, 19 aa, Homo sapiens
  Payload ID: 15416
  Gene Symbol: SEMA3A
  Gene Name: sema domain, immunoglobulin domain (Ig), short basic domain, secreted, (semaphorin) 3A
  ENSP ID: ENSP00000404800
MGWLTRIVCLFWGVLLTAR

SEQ ID NO: 77247 - protein, 771 aa, Homo sapiens [sequence omitted]

SEQ ID NO: 77248 - protein, 754 aa, Homo sapiens
  Payload ID: 15417
  Gene Symbol: SEMA3B
  Gene Name: sema domain, immunoglobulin domain (Ig), short basic domain, secreted, (semaphorin) 3B
  ENSP ID: ENSP00000480680
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLRPFPAEDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 77249 - protein, 749 aa, Homo sapiens
  Payload ID: 15417
  Gene Symbol: SEMA3B
  Gene Name: sema domain, immunoglobulin domain (Ig), short basic domain, secreted, (semaphorin) 3B
  Uniprot ID: Q13214
  ENSP ID: ENSP00000481957
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 77250 - protein, 214 aa, Homo sapiens
  Payload ID: 15417
  Gene Symbol: SEMA3B
  Gene Name: sema domain, immunoglobulin domain (Ig), short basic domain, secreted, (semaphorin) 3B
  ENSP ID: ENSP00000482586
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEP

SEQ ID NO: 77251 - protein, 749 aa, Homo sapiens; identical to SEQ ID NO: 77249
  Payload ID: 15417
  Gene Symbol: SEMA3B
  Gene Name: sema domain, immunoglobulin domain (Ig), short basic domain, secreted, (semaphorin) 3B
  Uniprot ID: Q13214
  ENSP ID: ENSP00000484146

SEQ ID NO: 77252 - protein, 457 aa, Homo sapiens
  Payload ID: 15417
  Gene Symbol: SEMA3B
  Gene Name: sema domain, immunoglobulin domain (Ig), short basic domain, secreted, (semaphorin) 3B
  ENSP ID: ENSP00000484583
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRQACAPARPLAPSVPPRTSQTMSSSLRGTTPSCTTLSCPLGGALFSYKLEPITPSLKLPRTGLQPLTDTMTSSSLAQTLARC

SEQ ID NO: 77253 - protein, 406 aa, Homo sapiens
  Payload ID: 15417
  Gene Symbol: SEMA3B
  Gene Name: sema domain, immunoglobulin domain (Ig), short basic domain, secreted, (semaphorin) 3B
  ENSP ID: ENSP00000485173
MNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 77254 - protein, 748 aa, Homo sapiens
  Payload ID: 15417
  Gene Symbol: SEMA3B
  Gene Name: sema domain, immunoglobulin domain (Ig), short basic domain, secreted, (semaphorin) 3B
  Uniprot ID: Q13214
  ENSP ID: ENSP00000485281
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 77255 - protein, 406 aa, Homo sapiens; identical to SEQ ID NO: 77253
  Payload ID: 15417
  Gene Symbol: SEMA3B
  Gene Name: sema domain, immunoglobulin domain (Ig), short basic domain, secreted, (semaphorin) 3B
  ENSP ID: ENSP00000485646

SEQ ID NO: 77256 - protein, 751 aa, Homo sapiens
  Payload ID: 15418
  Gene Symbol: SEMA3C
  Gene Name: sema domain, immunoglobulin domain (Ig), short basic domain, secreted, (semaphorin) 3C
  Uniprot ID: Q99985
  ENSP ID: ENSP00000265361
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 77257 - protein, 40 aa, Homo sapiens
  Payload ID: 15418
  Gene Symbol: SEMA3C
  Gene Name: sema domain, immunoglobulin domain (Ig), short basic domain, secreted, (semaphorin) 3C
  ENSP ID: ENSP00000393825
MAFRTICVLVGVFICSICVKGSSQPQARVYLTFDGPSFHD

SEQ ID NO: 77258 - protein, 63 aa, Homo sapiens
  Payload ID: 15418
  Gene Symbol: SEMA3C
  Gene Name: sema domain, immunoglobulin domain (Ig), short basic domain, secreted, (semaphorin) 3C
  ENSP ID: ENSP00000395398
MAFRTICVLVGVFICSICVKGSSQPQARVYLTFDEPTLYNAVCYICGYKKKCGVNLVLSNHLL

SEQ ID NO: 77259 - protein, 63 aa, Homo sapiens; identical to SEQ ID NO: 77258
  Payload ID: 15418
  Gene Symbol: SEMA3C
  Gene Name: sema domain, immunoglobulin domain (Ig), short basic domain, secreted, (semaphorin) 3C
  ENSP ID: ENSP00000399891

SEQ ID NO: 77260 - protein, 751 aa, Homo sapiens; identical to SEQ ID NO: 77256
  Payload ID: 15418
  Gene Symbol: SEMA3C
  Gene Name: sema domain, immunoglobulin domain (Ig), short basic domain, secreted, (semaphorin) 3C
  Uniprot ID: Q99985
  ENSP ID: ENSP00000411193

SEQ ID NO: 77261 - protein, 777 aa, Homo sapiens
  Payload ID: 15419
  Gene Symbol: SEMA3D
  Gene Name: sema domain, immunoglobulin domain (Ig), short basic domain, secreted, (semaphorin) 3D
  Uniprot ID: O95025
  ENSP ID: ENSP00000284136
MNANKDERLKARSQDFHLFPALMMLSMTMLFLPVTGTLKQNIPRLKLTYKDLLLSNSCIPFLGSSEGLDFQTLLLDEERGRLLLGAKDHIFLLSLVDLNKNFKKIYWPAAKERVELCKLAGKDANTECANFIRVLQPYNKTHIYVCGTGAFHPICGYIDLGVYKEDIIFKLDTHNLESGRLKCPFDPQQPFASVMTDEYLYSGTASDFLGKDTAFTRSLGPTHDHHYIRTDISEHYWLNGAKFIGTFFIPDTYNPDDDKIYFFFRESSQEGSTSDKTILSRVGRVCKNDVGGQRSLINKWTTFLKARLICSIPGSDGADTYFDELQDIYLLPTRDERNPVVYGVFTTTSSIFKGSAVCVYSMADIRAVFNGPYAHKESADHRWVQYDGRIPYPRPGTCPSKTYDPLIKSTRDFPDDVISFIKRHSVMYKSVYPVAGGPTFKRINVDYRLTQIVVDHVIAEDGQYDVMFLGTDIGTVLKVVSISKEKWNMEEVVLEELQIFKHSSIILNMELSLKQQQLYIGSRDGLVQLSLHRCDTYGKACADCCLARDPYCAWDGNACSRYAPTSKRRARRQDVKYGDPITQCWDIEDSISHETADEKVIFGIEFNSTFLECIPKSQQATIKWYIQRSGDEHREELKPDERIIKTEYGLLIRSLQKKDSGMYYCKAQEHTFIHTIVKLTLNVIENEQMENTQRAEHEEGKVKDLLAESRLRYKDYIQILSSPNFSLDQYCEQMWHREKRRQRNKGGPKWKHMQEMKKKRNRRHHRDLDELPRAVAT

SEQ ID NO: 77262 - protein, 294 aa, Homo sapiens
  Payload ID: 15419
  Gene Symbol: SEMA3D
  Gene Name: sema domain, immunoglobulin domain (Ig), short basic domain, secreted, (semaphorin) 3D
  ENSP ID: ENSP00000401366
MNANKDERLKARSQDFHLFPALMMLSMTMLFLPVTGTLKQNIPRLKLTYKDLLLSNSCIPFLGSSEGLDFQTLLLDEERGRLLLGAKDHIFLLSLVDLNKNFKKIYWPAAKERVELCKLAGKDANTECANFIRVLQPYNKTHIYVCGTGAFHPICGYIDLGVYKEDIIFKLDTHNLESGRLKCPFDPQQPFASVMTDEYLYSGTASDFLGKDTAFTRSLGPTHDHHYIRTDISEHYWLNGAKFIGTFFIPDTYNPDDDKIYFFFRESSQEGSTSDKTILSRVGRVCKENLCFED

SEQ ID NO: 77263 - protein, 775 aa, Homo sapiens
  Payload ID: 15420
  Gene Symbol: SEMA3E
  Gene Name: sema domain, immunoglobulin domain (Ig), short basic domain, secreted, (semaphorin) 3E
  Uniprot ID: O15041
  ENSP ID: ENSP00000303212
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 77264 - protein, 715 aa, Homo sapiens
  Payload ID: 15420
  Gene Symbol: SEMA3E
  Gene Name: sema domain, immunoglobulin domain (Ig), short basic domain, secreted, (semaphorin) 3E
  Uniprot ID: O15041
  ENSP ID: ENSP00000405052
MLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 77265 - protein, 163 aa, Homo sapiens
  Payload ID: 15420
  Gene Symbol: SEMA3E
  Gene Name: sema domain, immunoglobulin domain (Ig), short basic domain, secreted, (semaphorin) 3E
  ENSP ID: ENSP00000412867
MLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLK

SEQ ID NO: 77266 - protein, 39 aa, Homo sapiens
  Payload ID: 15420
  Gene Symbol: SEMA3E
  Gene Name: sema domain, immunoglobulin domain (Ig), short basic domain, secreted, (semaphorin) 3E
  ENSP ID: ENSP00000415184
MASAGHIITLLLWGYLLELWTGGHTADTTHPRLRLSHKE

SEQ ID NO: 77267 - protein, 785 aa, Homo sapiens
  Payload ID: 15421
  Gene Symbol: SEMA3F
  Gene Name: sema domain, immunoglobulin domain (Ig), short basic domain, secreted, (semaphorin) 3F
  Uniprot ID: Q13275
  ENSP ID: ENSP00000002829
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQATPWTQTQAVRGRGSRATDGALRPMPTAPRQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 77268 - protein, 686 aa, Homo sapiens
  Payload ID: 15421
  Gene Symbol: SEMA3F
  Gene Name: sema domain, immunoglobulin domain (Ig), short basic domain, secreted, (semaphorin) 3F
  ENSP ID: ENSP00000388931
MYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 77269 - protein, 264 aa, Homo sapiens
  Payload ID: 15421
  Gene Symbol: SEMA3F
  Gene Name: sema domain, immunoglobulin domain (Ig), short basic domain, secreted, (semaphorin) 3F
  ENSP ID: ENSP00000392588
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYAR

SEQ ID NO: 77270 - protein, 379 aa, Homo sapiens
  Payload ID: 15421
  Gene Symbol: SEMA3F
  Gene Name: sema domain, immunoglobulin domain (Ig), short basic domain, secreted, (semaphorin) 3F
  ENSP ID: ENSP00000398399
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPG

SEQ ID NO: 77271 - protein, 92 aa, Homo sapiens
  Payload ID: 15421
  Gene Symbol: SEMA3F
  Gene Name: sema domain, immunoglobulin domain (Ig), short basic domain, secreted, (semaphorin) 3F
  ENSP ID: ENSP00000400549
MLVAGLLLWASLLTGAWPSFPTQDHLPATPRVRLSFKELKATGTAHFFNFLLNTTDYRILLKDEDHDRMYVGSKDYVLSLDLHDINREPLIV

SEQ ID NO: 77272 - protein, 754 aa, Homo sapiens
  Payload ID: 15421
  Gene Symbol: SEMA3F
  Gene Name: sema domain, immunoglobulin domain (Ig), short basic domain, secreted, (semaphorin) 3F
  Uniprot ID: Q13275
  ENSP ID: ENSP00000409859
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 77273 - protein, 147 aa, Homo sapiens
  Payload ID: 15421
  Gene Symbol: SEMA3F
  Gene Name: sema domain, immunoglobulin domain (Ig), short basic domain, secreted, (semaphorin) 3F
  ENSP ID: ENSP00000416356
GTAHFFNFLLNTTDYRILLKDEDHDRMYVGSKDYVLSLDLHDINREPLIIHWAASPQRIEECVLSGKDVNPSLWPQGECGNFVRLIQPWNRTHLYVCGTGAYNPMCTYVNRGRRAQDYIFYLEPERLESGKGKCPYDPKLDTASALI

SEQ ID NO: 77274 - protein, 782 aa, Homo sapiens
  Payload ID: 15422
  Gene Symbol: SEMA3G
  Gene Name: sema domain, immunoglobulin domain (Ig), short basic domain, secreted, (semaphorin) 3G
  Uniprot ID: Q9NS98
  ENSP ID: ENSP00000231721
MAPSAWAICWLLGGLLLHGGSSGPSPGPSVPRLRLSYRDLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRGRCPHEPSRPFASTFIDGELYTGLTADFLGREAMIFRSGGPRPALRSDSDQSLLHDPRFVMAARIPENSDQDNDKVYFFFSETVPSPDGGSNHVTVSRVGRVCVNDAGGQRVLVNKWSTFLKARLVCSVPGPGGAETHFDQLEDVFLLWPKAGKSLEVYALFSTVSAVFQGFAVCVYHMADIWEVFNGPFAHRDGPQHQWGPYGGKVPFPRPGVCPSKMTAQPGRPFGSTKDYPDEVLQFARAHPLMFWPVRPRHGRPVLVKTHLAQQLHQIVVDRVEAEDGTYDVIFLGTDSGSVLKVIALQAGGSAEPEEVVLEELQVFKVPTPITEMEISVKRQMLYVGSRLGVAQLRLHQCETYGTACAECCLARDPYCAWDGASCTHYRPSLGKRRFRRQDIRHGNPALQCLGQSQEEEAVGLVAATMVYGTEHNSTFLECLPKSPQAAVRWLLQRPGDEGPDQVKTDERVLHTERGLLFRRLSRFDAGTYTCTTLEHGFSQTVVRLALVVIVASQLDNLFPPEPKPEEPPARGGLASTPPKAWYKDILQLIGFANLPRVDEYCERVWCRGTTECSGCFRSRSRGKQARGKSWAGLELGKKMKSRVHAEHNRTPREVEAT

SEQ ID NO: 77275 - protein, 186 aa, Homo sapiens
  Payload ID: 15422
  Gene Symbol: SEMA3G
  Gene Name: sema domain, immunoglobulin domain (Ig), short basic domain, secreted, (semaphorin) 3G
  ENSP ID: ENSP00000419181
MAPSAWAICWLLGGLLLHGGSSGPSPGPSVPRLRLSYRGAMVRKPSSTMWMETFSRYLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRG

SEQ ID NO: 77276 - protein, 99 aa, Homo sapiens
  Payload ID: 15422
  Gene Symbol: SEMA3G
  Gene Name: sema domain, immunoglobulin domain (Ig), short basic domain, secreted, (semaphorin) 3G
  ENSP ID: ENSP00000420291
  MOD_RES (1)..(1): Any amino acid
XSSGPSPGPSVPRLRLSYRDRVRQLRAGATASQPDPPASLWHWGLPAHLCPHHSWPPWGACAPPGAWQCGKWPGAVPSRAQPSLCQHLHRRGAVHGSHC

SEQ ID NO: 77277 - protein, 761 aa, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  Uniprot ID: Q9H3S1
  ENSP ID: ENSP00000347117
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 77278 - protein, 761 aa, Homo sapiens; identical to SEQ ID NO: 77277
  Payload ID: 15423
  Gene Symbol: SEMA4A
  Gene Name: sema domain, immunoglobulin domain (Ig), transmembrane domain (TM) and short cytoplasmic domain, (semaphorin) 4A
  Uniprot ID: Q9H3S1
  ENSP ID: ENSP00000357265

SEQ ID NO: 77279 - protein, 629 aa, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  Uniprot ID: Q9H3S1
  ENSP ID: ENSP00000357267
MIPWPASDRKKSECAFKKKSNEELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 77280 - protein, 761 aa, Homo sapiens; identical to SEQ ID NO: 77277
  Payload ID: 15423
  Gene Symbol: SEMA4A
  Gene Name: sema domain, immunoglobulin domain (Ig), transmembrane domain (TM) and short cytoplasmic domain, (semaphorin) 4A
  Uniprot ID: Q9H3S1
  ENSP ID: ENSP00000357268

SEQ ID NO: 77281 - protein, 723 aa, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENSP ID: ENSP00000357269
MPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 77282 - protein, 236 aa, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENSP ID: ENSP00000392865
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNEELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVC

SEQ ID NO: 77283 - protein, 220 aa, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENSP ID: ENSP00000399230
MIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPH

SEQ ID NO: 77284 - protein, 321 aa, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENSP ID: ENSP00000401391
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIY

SEQ ID NO: 77285 - protein, 100 aa, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENSP ID: ENSP00000487730
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNM

SEQ ID NO: 77286 - protein, 837 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000332204
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGSRVFTESEKRPLSIQDSFVEVSPVCPRPRVRLGSEIRDSVV

SEQ ID NO: 77287 - protein, 837 aa, Homo sapiens; identical to SEQ ID NO: 77286
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000394720

SEQ ID NO: 77288 - protein, 51 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000452957
MAGPCTWVLERPSLHSVATSASCQAGSTRSCFGVQTQRRNSSAASRARTHR

SEQ ID NO: 77289 - protein, 113 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000453272
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGAD

SEQ ID NO: 77290 - protein, 63 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000453484
MLRTAMGLRSWLAAPWGALPPRPPLLLLLLLLLLLQPPPPTWALSPRISLPLGWGYVKTLHRL

SEQ ID NO: 77291 - protein, 121 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000453563
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCS

SEQ ID NO: 77292 - protein, 91 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000453705
MLRTAMGLRSWLAAPWGALPPRPPLLLLLLLLLLLQPPPPTWALSPRISLPLGSEERPFLRFEAEHISNYTALLLSRDGRTLYVGAREALF

SEQ ID NO: 77293 - protein, 461 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000453804
  MOD_RES (1)..(1): Any amino acid
XARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSWARTQLLDLSSLYQAVATREDSASSGEIS

SEQ ID NO: 77294 - protein, 253 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000453866
  MOD_RES (1)..(1): Any amino acid
XRSRMLLLQPQARYQRVAVHRVPGLHHTYDVLFLGTGDGRLHKAVSVGPRVHIIEELQIFSSGQPVQNLLLDTHRVSRPTRNPGRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVV

SEQ ID NO: 77295 - protein, 115 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000453951
MAGPCTWVLERPSLHSVATSASCQAGSTRSCFGVQTQRRNSSAASRARTHSATVKTTSRSSCRSAAVTCSPVAQQPSAPCVPTSTWRTSPWQGTRRGMSSWKMARAVVPSTRISS

SEQ ID NO: 77296 - protein, 120 aa, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENSP ID: ENSP00000454068
  MOD_RES (1)..(1): Any amino acid
XHIIEELQIFSSGQPVQNLLLDTHRGLLYAASHSGVVQVPMANCSLYRSCGDCLLARDPYCAWSGSSCKHVSLYQPQLATRILSGPQAVDPGHRGSQRQGPLQRVFGCVPVFCTNRGEAM

SEQ ID NO: 77297 - protein, 833 aa, Homo sapiens
  Payload ID: 15425
  Gene Symbol: SEMA4C
  Gene Name: sema domain, immunoglobulin domain (Ig), transmembrane domain (TM) and short cytoplasmic domain, (semaphorin) 4C
  Uniprot ID: Q9C0C4
  ENSP ID: ENSP00000306844
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 77298 - protein, 139 aa, Homo sapiens
  Payload ID: 15425
  Gene Symbol: SEMA4C
  Gene Name: sema domain, immunoglobulin domain (Ig), transmembrane domain (TM) and short cytoplasmic domain, (semaphorin) 4C
  ENSP ID: ENSP00000391094
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTY

SEQ ID NO: 77299 - protein, 201 aa, Homo sapiens
  Payload ID: 15425
  Gene Symbol: SEMA4C
  Gene Name: sema domain, immunoglobulin domain (Ig), transmembrane domain (TM) and short cytoplasmic domain, (semaphorin) 4C
  ENSP ID: ENSP00000393498
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSM

SEQ ID NO: 77300 - protein, 738 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENSP ID: ENSP00000344923
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPASSPKPLPPPGSSSLSCLGHVGDRRLSSPWTPWPASGAGPDSSSRVSLLPPFLSDQAQHVHALGNFYLFCQATGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 77301 - protein, 862 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENSP ID: ENSP00000348822
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNRLLMSLFLFFFVLFLCLFFYNCYKGYLPRQCLKFRSALLIGKKKPKSDFCDREQSLKETLVEPGSFSQQNGEHPKPALDTGYETEQDTITSKVPTDREDSQRIDDLSARDKPFDVKCELKFADSDADGD

SEQ ID NO: 77302 - protein, 862 aa, Homo sapiens; identical to SEQ ID NO: 77301
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENSP ID: ENSP00000388768

SEQ ID NO: 77303 - protein, 146 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENSP ID: ENSP00000390754
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFL

SEQ ID NO: 77304 - protein, 738 aa, Homo sapiens; identical to SEQ ID NO: 77300
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENSP ID: ENSP00000391733

SEQ ID NO: 77305 - protein, 548 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENSP ID: ENSP00000395222
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKVLQTFALSGRRMGELWRPVSLCRPMHCPMAGPMHSAGCRTPSGKALSIAALSSPQQGTRLRRCRLL

SEQ ID NO: 77306 - protein, 123 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENSP ID: ENSP00000399948
MWTQRWKRSVSPGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 77307 - protein, 862 aa, Homo sapiens; identical to SEQ ID NO: 77301
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENSP ID: ENSP00000405102

SEQ ID NO: 77308 - protein, 1 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENSP ID: ENSP00000405652
M

SEQ ID NO: 77309 - protein, 738 aa, Homo sapiens; identical to SEQ ID NO: 77300
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENSP ID: ENSP00000411981

SEQ ID NO: 77310 - protein, 75 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENSP ID: ENSP00000413352
MRMCTPIRGLLMALAVMFGTAMAFAPIPRITWEHREVHLVQFHEPDIYNYSALLLSEDKDTLYIGAREAVFAVNA

SEQ ID NO: 77311 - protein, 862 aa, Homo sapiens; identical to SEQ ID NO: 77301
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENSP ID: ENSP00000416523

SEQ ID NO: 77312 - protein, 59 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENSP ID: ENSP00000416747
MRMCTPIRGLLMALAVMFGTAMAFAPIPRITWEHREVHLVQFHEPDIYNYSALLLSEDK

SEQ ID NO: 77313 - protein, 66 aa, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENSP ID: ENSP00000438389
MRMCTPIRGLLMALAVMFGTAMAFAPIPRITWEHREVHLVQFHEPDIYNYSALLLSEDKDTLYIGA

SEQ ID NO: 77314 - protein, 548 aa, Homo sapiens; identical to SEQ ID NO: 77305
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENSP ID: ENSP00000446394

SEQ ID NO: 77315 - protein, 615 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  Uniprot ID: O95754
  ENSP ID: ENSP00000342675
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 77316 - protein, 770 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  Uniprot ID: O95754
  ENSP ID: ENSP00000350547
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 77317 - protein, 68 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENSP ID: ENSP00000396703
MPASAARPRPGPGQPTASPFPLLLLAVLSGPVSGRVPRSVPRTSLPISVFRRKNRGGGYDPLKRCGRS

SEQ ID NO: 77318 - protein, 164 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENSP ID: ENSP00000407698
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDVSRFQQVERLESGRGKCPFEPAQRSAAVMAGGVLYAATVKNYLG

SEQ ID NO: 77319 - protein, 178 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENSP ID: ENSP00000409141
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEGDLGGRKTLQQRWTTFLKADLLCPGPEHGRASSVLQDVAVLRPELGAGTPIFYGIFSSQ

SEQ ID NO: 77320 - protein, 49 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENSP ID: ENSP00000413882
MPASAARPRPGPGQPTASPFPLLLLAVLSGPVSGRVPRSVPRTSLPISD

SEQ ID NO: 77321 - protein, 127 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENSP ID: ENSP00000413916
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEGGSSMLPL

SEQ ID NO: 77322 - protein, 160 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENSP ID: ENSP00000416490
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIGGSSMLPL

SEQ ID NO: 77323 - protein, 737 aa, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENSP ID: ENSP00000482238
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 77324 - protein, 843 aa, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  Uniprot ID: Q9NTN9
  ENSP ID: ENSP00000210633
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRSQGSRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 77325 - protein, 838 aa, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  Uniprot ID: Q9NTN9
  ENSP ID: ENSP00000359270
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 77326 - protein, 522 aa, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  ENSP ID: ENSP00000428896
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARD

SEQ ID NO: 77327 - protein, 131 aa, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  ENSP ID: ENSP00000429888
  MOD_RES (1)..(1): Any amino acid
XREGRRGRRRKYSLGRASRAGGSAVQLQTVSGRALQVHMGSMSPPSAWPCVLDGPETRQDLCQPPKPCVHSHAHMEECLSAGLQCPHPHLLLVHSCFIPASGLGVPSQLPHPIWSSSPAPCGDLFVKSLGT

SEQ ID NO: 77328 - protein, 170 aa, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  ENSP ID: ENSP00000430103
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARG

SEQ ID NO: 77329 - protein, 702 aa, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  Uniprot ID: Q9NTN9
  ENSP ID: ENSP00000430175
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRSQGSRTALIQDIERGNRGCESSRDTGRALQVHMGSMSPPSAWPCVLDGPETRQDLCQPPKPCVHSHAHMEECLSAGLQCPHPHLLLVHSCFIPASGLGVPSQLPHPIWSSSPAPCGDLFVKSLGTGQPGEVRLHHSPPLPSCVALVNQPPHSPWSFSRV

SEQ ID NO: 77330 - protein, 838 aa, Homo sapiens; identical to SEQ ID NO: 77325
  Payload ID: 15428
  Gene Symbol: SEMA4G
  Gene Name: sema domain, immunoglobulin domain (Ig), transmembrane domain (TM) and short cytoplasmic domain, (semaphorin) 4G
  Uniprot ID: Q9NTN9
  ENSP ID: ENSP00000430881

SEQ ID NO: 77331 - protein, 127 aa, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  ENSP ID: ENSP00000479499
MGSMSPPSAWPCVLDGPETRQDLCQPPKPCVHSHAHMEECLSAGLQCPHPHLLLVHSCFIPASGLGVPSQLPHPIWSSSPAPCGDLFVKSLGTGQPGEVRLHHSPPLPSCVALVNQPPHSPWSFSRV

SEQ ID NO: 77332 - protein, 1074 aa, Homo sapiens
  Payload ID: 15429
  Gene Symbol: SEMA5A
  Gene Name: sema domain, seven thrombospondin repeats (type 1 and type 1-like), transmembrane domain (TM) and short cytoplasmic domain, (semaphorin) 5A
  Uniprot ID: Q13591
  ENSP ID: ENSP00000371936
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILMHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGGHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNILPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNMFHMIAVGLSSSILGCLLTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 77333 - protein, 254 aa, Homo sapiens
  Payload ID: 15429
  Gene Symbol: SEMA5A
  Gene Name: sema domain, seven thrombospondin repeats (type 1 and type 1-like), transmembrane domain (TM) and short cytoplasmic domain, (semaphorin) 5A
  ENSP ID: ENSP00000421961
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVC

SEQ ID NO: 77334 - protein, 1057 aa, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENSP ID: ENSP00000195173
MVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 77335 - protein, 1151 aa, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  Uniprot ID: Q9P283
  ENSP ID: ENSP00000350215
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 77336 - protein, 1088 aa, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENSP ID: ENSP00000377208
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTP

SEQ ID NO: 77337 - protein, 1205 aa, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  Uniprot ID: Q9P283
  ENSP ID: ENSP00000389588
MLHLSAEEAIGCVRVRRSFIDELAFGRGHSTGTGKQKRRDRVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 77338 - protein, 197 aa, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENSP ID: ENSP00000400828
  MOD_RES (1)..(1): Any amino acid
XRSCTSPAPSPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 77339 - protein, 84 aa, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENSP ID: ENSP00000401038
MPCGFSPSPVAHHLVPGPPDTPAQQLRCGWTVGGWLLSLVRGLLPCLPPGARTAEGPIMVLAGPLAVSLLLPSLTLLVSHLSSS

SEQ ID NO: 77340 - protein, 142 aa, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENSP ID: ENSP00000401056
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGA

SEQ ID NO: 77341 - protein, 1094 aa, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENSP ID: ENSP00000417570
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGKRNRTYLMLRSSQPSGTPLQSLDSFHILLQTAKLCWGPHCFEMGSISSTWWPRASPASWALGS

SEQ ID NO: 77342 - protein, 1151 aa, Homo sapiens; identical to SEQ ID NO: 77335
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  Uniprot ID: Q9P283
  ENSP ID: ENSP00000479602

SEQ ID NO: 77343 - protein, 1047 aa, Homo sapiens
  Payload ID: 15431
  Gene Symbol: SEMA6A
  Gene Name: sema domain, transmembrane domain (TM), and cytoplasmic domain, (semaphorin) 6A
  ENSP ID: ENSP00000257414
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNDISTPLPDNEMSYNTVYGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 77344 - protein, 1030 aa, Homo sapiens
  Payload ID: 15431
  Gene Symbol: SEMA6A
  Gene Name: sema domain, transmembrane domain (TM), and cytoplasmic domain, (semaphorin) 6A
  Uniprot ID: Q9H2E6
  ENSP ID: ENSP00000345512
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 77345 - protein, 159 aa, Homo sapiens
  Payload ID: 15431
  Gene Symbol: SEMA6A
  Gene Name: sema domain, transmembrane domain (TM), and cytoplasmic domain, (semaphorin) 6A
  ENSP ID: ENSP00000421935
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEF

SEQ ID NO: 77346 - protein, 545 aa, Homo sapiens
  Payload ID: 15431
  Gene Symbol: SEMA6A
  Gene Name: sema domain, transmembrane domain (TM), and cytoplasmic domain, (semaphorin) 6A
  ENSP ID: ENSP00000422275
  MOD_RES (1)..(1): Any amino acid
XYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 77347 - protein, 457 aa, Homo sapiens
  Payload ID: 15431
  Gene Symbol: SEMA6A
  Gene Name: sema domain, transmembrane domain (TM), and cytoplasmic domain, (semaphorin) 6A
  ENSP ID: ENSP00000422997
MKTGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 77348 - protein, 1030 aa, Homo sapiens; identical to SEQ ID NO: 77344
  Payload ID: 15431
  Gene Symbol: SEMA6A
  Gene Name: sema domain, transmembrane domain (TM), and cytoplasmic domain, (semaphorin) 6A
  Uniprot ID: Q9H2E6
  ENSP ID: ENSP00000424388

SEQ ID NO: 77349 - protein, 409 aa, Homo sapiens
  Payload ID: 15431
  Gene Symbol: SEMA6A
  Gene Name: sema domain, transmembrane domain (TM), and cytoplasmic domain, (semaphorin) 6A
  ENSP ID: ENSP00000425364
MKNASPETREGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 77350 - protein, 114 aa, Homo sapiens
  Payload ID: 15431
  Gene Symbol: SEMA6A
  Gene Name: sema domain, transmembrane domain (TM), and cytoplasmic domain, (semaphorin) 6A
  ENSP ID: ENSP00000425553
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHK

SEQ ID NO: 77351 - protein, 677 aa, Homo sapiens
  Payload ID: 15432
  Gene Symbol: SEMA6B
  Gene Name: sema domain, transmembrane domain (TM), and cytoplasmic domain, (semaphorin) 6B
  Uniprot ID: Q9H3T3
  ENSP ID: ENSP00000465722
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKEPYFVHAVEWGSHVYFFFREIAMEFNYLEKVVVSRVARVCKNDVGGSPRVLEKQWTSFLKARLNCSVPGDSHFYFNVLQAVTGVVSLGGRPVVLAVFSTPSNSIPGSAVCAFDLTQVAAVFEGRFREQKSPESIWTPVPEDQVPRPRPGCCAAPGMQYNASSALPDDILNFVKTHPLMDEAVPSLGHAPWILRTLMRHQLTRVAVDVGAGPWGNQTVVFLGSEAGTVLKFLVRPNASTSGTSGLSVFLEEFETYRPDRCGRPGGGETGQRLLSLELDAASGGLLAAFPRCVVRVPVARCQQYSGCMKNCIGSQDPYCGWAPDGSCIFLSPGTRAAFEQDVSGASTSGLGDCTGLLRASLSEDRAGLVSVNLLVTSSVAAFVVGAVVSGFSVGVCVRASEGCCGRVCQVGHACRVCVHERRSWWPQRPGRWLSRRWGFQKARGSPRCRLGV

SEQ ID NO: 77352 - protein, 888 aa, Homo sapiens
  Payload ID: 15432
  Gene Symbol: SEMA6B
  Gene Name: sema domain, transmembrane domain (TM), and cytoplasmic domain, (semaphorin) 6B
  Uniprot ID: Q9H3T3
  ENSP ID: ENSP00000467290
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKEPYFVHAVEWGSHVYFFFREIAMEFNYLEKVVVSRVARVCKNDVGGSPRVLEKQWTSFLKARLNCSVPGDSHFYFNVLQAVTGVVSLGGRPVVLAVFSTPSNSIPGSAVCAFDLTQVAAVFEGRFREQKSPESIWTPVPEDQVPRPRPGCCAAPGMQYNASSALPDDILNFVKTHPLMDEAVPSLGHAPWILRTLMRHQLTRVAVDVGAGPWGNQTVVFLGSEAGTVLKFLVRPNASTSGTSGLSVFLEEFETYRPDRCGRPGGGETGQRLLSLELDAASGGLLAAFPRCVVRVPVARCQQYSGCMKNCIGSQDPYCGWAPDGSCIFLSPGTRAAFEQDVSGASTSGLGDCTGLLRASLSEDRAGLVSVNLLVTSSVAAFVVGAVVSGFSVGWFVGLRERRELARRKDKEAILAHGAGEAVLSVSRLGERRAQGPGGRGGGGGGGAGVPPEALLAPLMQNGWAKATLLQGGPHDLDSGLLPTPEQTPLPQKRLPTPHPHPHALGPRAWDHGHPLLPASASSSLLLLAPARAPEQPPAPGEPTPDGRLYAARPGRASHGDFPLTPHASPDRRRVVSAPTGPLDPASAADGLPRPWSPPPTGSLRRPLGPHAPPAATLRRTHTFNSGEARPGDRHRGCHARPGTDLAHLLPYGGADRTAPPVP

SEQ ID NO: 77353 - protein, 930 aa, Homo sapiens
  Payload ID: 15433
  Gene Symbol: SEMA6C
  Gene Name: sema domain, transmembrane domain (TM), and cytoplasmic domain, (semaphorin) 6C
  Uniprot ID: Q9H3T2
  ENSP ID: ENSP00000344148
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 77354 - protein, 922 aa, Homo sapiens
  Payload ID: 15433
  Gene Symbol: SEMA6C
  Gene Name: sema domain, transmembrane domain (TM), and cytoplasmic domain, (semaphorin) 6C
  Uniprot ID: Q9H3T2
  ENSP ID: ENSP00000357908
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYVLPGPGPSPGTPSPPSDAHPRPQSSTLGVHTRGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 77355 - protein, 962 aa, Homo sapiens
  Payload ID: 15433
  Gene Symbol: SEMA6C
  Gene Name: sema domain, transmembrane domain (TM), and cytoplasmic domain, (semaphorin) 6C
  Uniprot ID: Q9H3T2
  ENSP ID: ENSP00000357909
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYVLPGPGPSPGTPSPPSDAHPRPQSSTLGVHTRGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 77356 - protein, 930 aa, Homo sapiens; identical to SEQ ID NO: 77353
  Payload ID: 15433
  Gene Symbol: SEMA6C
  Gene Name: sema domain, transmembrane domain (TM), and cytoplasmic domain, (semaphorin) 6C
  Uniprot ID: Q9H3T2
  ENSP ID: ENSP00000357910

SEQ ID NO: 77357 - protein, 537 aa, Homo sapiens [sequence omitted]

SEQ ID NO: 77358 - protein, 537 aa, Homo sapiens
  Payload ID: 15433
  Gene Symbol: SEMA6C
  Gene Name: sema domain, transmembrane domain (TM), and cytoplasmic domain, (semaphorin) 6C
  ENSP ID: ENSP00000483227
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCPAHSSPLGRSLQVLRGSREAPPVPGPARGLPGPRPEKGGRREAPVVPEASPRRALLPPGRPERRPFQLLKGAAHGLQRGERPSPLGHELDALQDVSPPPRPAPPAFPTRRVSRGPFSPRVYLLTVFPPVLDRRVGGEKPVSSVSQHFRGSWRTPTPRSLPAKLP

SEQ ID NO: 77359 - protein, 1073 aa, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000324857
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 77360 - protein, 1017 aa, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000346786
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 77361 - protein, 597 aa, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000348276
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHDMEVSSSSVTTMVYDGKSSLESPTRWST

SEQ ID NO: 77362 - protein, 1011 aa, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000350770
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLLLTEDFFAFHNHSAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 77363 - protein, 476 aa, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000374076
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAK

SEQ ID NO: 77364 - protein, 998 aa, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000374079
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 77365 - protein, 1011 aa, Homo sapiens; identical to SEQ ID NO: 77362
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000442040

SEQ ID NO: 77366 - protein, 1073 aa, Homo sapiens; identical to SEQ ID NO: 77359
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000446152

SEQ ID NO: 77367 - protein, 1011 aa, Homo sapiens; identical to SEQ ID NO: 77362
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000452815

SEQ ID NO: 77368 - protein, 22 aa, Homo sapiens
  Payload ID: 15434
  Gene Symbol: SEMA6D
  Gene Name: sema domain, transmembrane domain (TM), and cytoplasmic domain, (semaphorin) 6D
  ENSP ID: ENSP00000453097
MRVFLLCAYILLLMVSQLRAVS

SEQ ID NO: 77369 - protein, 1 aa, Homo sapiens
  Payload ID: 15434
  Gene Symbol: SEMA6D
  Gene Name: sema domain, transmembrane domain (TM), and cytoplasmic domain, (semaphorin) 6D
  ENSP ID: ENSP00000453420
M

SEQ ID NO: 77370 - protein, 54 aa, Homo sapiens
  Payload ID: 15434
  Gene Symbol: SEMA6D
  Gene Name: sema domain, transmembrane domain (TM), and cytoplasmic domain, (semaphorin) 6D
  ENSP ID: ENSP00000453518
  MOD_RES (1)..(1): Any amino acid
XLLTEDFFAFHNHSAEGYEQDTEFGNTAHLGDCHEILPTSTTPDYKIFGGPTSG

SEQ ID NO: 77371 - protein, 148 aa, Homo sapiens
  Payload ID: 15434
  Gene Symbol: SEMA6D
  Gene Name: sema domain, transmembrane domain (TM), and cytoplasmic domain, (semaphorin) 6D
  ENSP ID: ENSP00000453530
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYY

SEQ ID NO: 77372 - protein, 597 aa, Homo sapiens; identical to SEQ ID NO: 77361
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENSP ID: ENSP00000453661

SEQ ID NO: 77373 - protein, 198 aa, Homo sapiens
  Payload ID: 15434
  Gene Symbol: SEMA6D
  Gene Name: sema domain, transmembrane domain (TM), and cytoplasmic domain, (semaphorin) 6D
  ENSP ID: ENSP00000453689
  MOD_RES (1)..(1): Any amino acid
XLTEDFFAFHNHSAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDS

SEQ ID NO: 77374 - protein, 219 aa, Homo sapiens
  Payload ID: 15434
  Gene Symbol: SEMA6D
  Gene Name: sema domain, transmembrane domain (TM), and cytoplasmic domain, (semaphorin) 6D
  ENSP ID: ENSP00000453755
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIK

SEQ ID NO: 77375 - protein, 666 aa, Homo sapiens
  Payload ID: 15435
  Gene Symbol: SEMA7A
  Gene Name: semaphorin 7A, GPI membrane anchor (John Milton Hagen blood group)
  Uniprot ID: O75326
  ENSP ID: ENSP00000261918
MTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTVNIGSTKGSCLDKRDCENYITLLERRSEGLLACGTNARHPSCWNLVNGTVVPLGEMRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 77376 - protein, 652 aa, Homo sapiens
  Payload ID: 15435
  Gene Symbol: SEMA7A
  Gene Name: semaphorin 7A, GPI membrane anchor (John Milton Hagen blood group)
  Uniprot ID: O75326
  ENSP ID: ENSP00000438966
MTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTDCENYITLLERRSEGLLACGTNARHPSCWNLVNGTVVPLGEMRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 77377 - protein, 501 aa, Homo sapiens
  Payload ID: 15435
  Gene Symbol: SEMA7A
  Gene Name: semaphorin 7A, GPI membrane anchor (John Milton Hagen blood group)
  ENSP ID: ENSP00000441493
MRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 77378 - protein, 80 aa, Homo sapiens
  Payload ID: 15435
  Gene Symbol: SEMA7A
  Gene Name: semaphorin 7A, GPI membrane anchor (John Milton Hagen blood group)
  ENSP ID: ENSP00000454365
MRGYAPFSPDENSLVLFEGDEVYSTIRKQEYNGKIPRFRRIRGESELYTSDTVMQNPQFIKATIVHQDQAYDDKIYYFFR

SEQ ID NO: 77379 - protein, 462 aa, Homo sapiens
  Payload ID: 15436
  Gene Symbol: SEMG1
  Gene Name: semenogelin I
  Uniprot ID: P04279
  ENSP ID: ENSP00000361867
MKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 77380 - protein, 582 aa, Homo sapiens
  Payload ID: 15437
  Gene Symbol: SEMG2
  Gene Name: semenogelin II
  Uniprot ID: Q02383
  ENSP ID: ENSP00000361855
MKSIILFVLSLLLILEKQAAVMGQKGGSKGQLPSGSSQFPHGQKGQHYFGQKDQQHTKSKGSFSIQHTYHVDINDHDWTRKSQQYDLNALHKATKSKQHLGGSQQLLNYKQEGRDHDKSKGHFHMIVIHHKGGQAHHGTQNPSQDQGNSPSGKGLSSQCSNTEKRLWVHGLSKEQASASGAQKGRTQGGSQSSYVLQTEELVVNKQQRETKNSHQNKGHYQNVVDVREEHSSKLQTSLHPAHQDRLQHGPKDIFTTQDELLVYNKNQHQTKNLSQDQEHGRKAHKISYPSSRTEERQLHHGEKSVQKDVSKGSISIQTEEKIHGKSQNQVTIHSQDQEHGHKENKISYQSSSTEERHLNCGEKGIQKGVSKGSISIQTEEQIHGKSQNQVRIPSQAQEYGHKENKISYQSSSTEERRLNSGEKDVQKGVSKGSISIQTEEKIHGKSQNQVTIPSQDQEHGHKENKMSYQSSSTEERRLNYGGKSTQKDVSQSSISFQIEKLVEGKSQIQTPNPNQDQWSGQNAKGKSGQSADSKQDLLSHEQKGRYKQESSESHNIVITEHEVAQDDHLTQQYNEDRNPIST

SEQ ID NO: 77381 - protein, 2677 aa, Homo sapiens
  Payload ID: 15438
  Gene Symbol: SETX
  Gene Name: senataxin
  Uniprot ID: Q7Z333
  ENSP ID: ENSP00000224140
MSTCCWCTPGGASTIDFLKRYASNTPSGEFQTADEDLCYCLECVAEYHKARDELPFLHEVLWELETLRLINHFEKSMKAEIGDDDELYIVDNNGEMPLFDITGQDFENKLRVPLLEILKYPYLLLHERVNELCVEALCRMEQANCSFQVFDKHPGIYLFLVHPNEMVRRWAILTARNLGKVDRDDYYDLQEVLLCLFKVIELGLLESPDIYTSSVLEKGKLILLPSHMYDTTNYKSYWLGICMLLTILEEQAMDSLLLGSDKQNDFMQSILHTMEREADDDSVDPFWPALHCFMVILDRLGSKVWGQLMDPIVAFQTIINNASYNREIRHIRNSSVRTKLEPESYLDDMVTCSQIVYNYNPEKTKKDSGWRTAICPDYCPNMYEEMETLASVLQSDIGQDMRVHNSTFLWFIPFVQSLMDLKDLGVAYIAQVVNHLYSEVKEVLNQTDAVCDKVTEFFLLILVSVIELHRNKKCLHLLWVSSQQWVEAVVKCAKLPTTAFTRSSEKSSGNCSKGTAMISSLSLHSMPSNSVQLAYVQLIRSLLKEGYQLGQQSLCKRFWDKLNLFLRGNLSLGWQLTSQETHELQSCLKQIIRNIKFKAPPCNTFVDLTSACKISPASYNKEESEQMGKTSRKDMHCLEASSPTFSKEPMKVQDSVLIKADNTIEGDNNEQNYIKDVKLEDHLLAGSCLKQSSKNIFTERAEDQIKISTRKQKSVKEISSYTPKDCTSRNGPERGCDRGIIVSTRLLTDSSTDALEKVSTSNEDFSLKDDALAKTSKRKTKVQKDEICAKLSHVIKKQHRKSTLVDNTINLDENLTVSNIESFYSRKDTGVQKGDGFIHNLSLDPSGVLDDKNGEQKSQNNVLPKEKQLKNEELVIFSFHENNCKIQEFHVDGKELIPFTEMTNASEKKSSPFKDLMTVPESRDEEMSNSTSVIYSNLTREQAPDISPKSDTLTDSQIDRDLHKLSLLAQASVITFPSDSPQNSSQLQRKVKEDKRCFTANQNNVGDTSRGQVIIISDSDDDDDERILSLEKLTKQDKICLEREHPEQHVSTVNSKEEKNPVKEEKTETLFQFEESDSQCFEFESSSEVFSVWQDHPDDNNSVQDGEKKCLAPIANTTNGQGCTDYVSEVVKKGAEGIEEHTRPRSISVEEFCEIEVKKPKRKRSEKPMAEDPVRPSSSVRNEGQSDTNKRDLVGNDFKSIDRRTSTPNSRIQRATTVSQKKSSKLCTCTEPIRKVPVSKTPKKTHSDAKKGQNRSSNYLSCRTTPAIVPPKKFRQCPEPTSTAEKLGLKKGPRKAYELSQRSLDYVAQLRDHGKTVGVVDTRKKTKLISPQNLSVRNNKKLLTSQELQMQRQIRPKSQKNRRRLSDCESTDVKRAGSHTAQNSDIFVPESDRSDYNCTGGTEVLANSNRKQLIKCMPSEPETIKAKHGSPATDDACPLNQCDSVVLNGTVPTNEVIVSTSEDPLGGGDPTARHIEMAALKEGEPDSSSDAEEDNLFLTQNDPEDMDLCSQMENDNYKLIELIHGKDTVEVEEDSVSRPQLESLSGTKCKYKDCLETTKNQGEYCPKHSEVKAADEDVFRKPGLPPPASKPLRPTTKIFSSKSTSRIAGLSKSLETSSALSPSLKNKSKGIQSILKVPQPVPLIAQKPVGEMKNSCNVLHPQSPNNSNRQGCKVPFGESKYFPSSSPVNILLSSQSVSDTFVKEVLKWKYEMFLNFGQCGPPASLCQSISRPVPVRFHNYGDYFNVFFPLMVLNTFETVAQEWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 77382 - protein, 948 aa, Homo sapiens
  Payload ID: 15438
  Gene Symbol: SETX
  Gene Name: senataxin
  ENSP ID: ENSP00000409143
VAQEWLNSPNRENFYQLQVRKFPADYIKYWEFAVYLEECELAKQLYPKENDLVFLAPERINEEKKDTERNDIQDLHEYHSGYVHKFRRTSVMRNGKTECYLSIQTQENFPANLNELVNCIVISSLVTTQRKLKAMSLLGSRNQLARAVLNPNPMDFCTKDLLTTTSERIIAYLRDFNEDQKKAIETAYAMVKHSPSVAKICLIHGPPGTGKSKTIVGLLYRLLTENQRKGHSDENSNAKIKQNRVLVCAPSNAAVDELMKKIILEFKEKCKDKKNPLGNCGDINLVRLGPEKSINSEVLKFSLDSQVNHRMKKELPSHVQAMHKRKEFLDYQLDELSRQRALCRGGREIQRQELDENISKVSKERQELASKIKEVQGRPQKTQSIIILESHIICCTLSTSGGLLLESAFRGQGGVPFSCVIVDEAGQSCEIETLTPLIHRCNKLILVGDPKQLPPTVISMKAQEYGYDQSMMARFCRLLEENVEHNMISRLPILQLTVQYRMHPDICLFPSNYVYNRNLKTNRQTEAIRCSSDWPFQPYLVFDVGDGSERRDNDSYINVQEIKLVMEIIKLIKDKRKDVSFRNIGIITHYKAQKTMIQKDLDKEFDRKGPAEVDTVDAFQGRQKDCVIVTCVRANSIQGSIGFLASLQRLNVTITRAKYSLFILGHLRTLMQLLPRSFCVHVNHSPFFSPEPKYLHWALKENQHWNQLIQDAQKRGAIIKTCDKNYRHDAVKILKLKPVLQRSLTHPPTIAPEGSRPQGGLPSSKLDSGFAKTSVAASLYHTPSDSKEITLTVTSKDPERPPVHDQLQDPRLLKRMGIEVKGGIFLWDPQPSSPQHPGATPPTGEPGFPVVHQDLSHIQQPAAVVAALSSHKPPVRGEPPAASPEASTCQSKCDDPEEELCHRREARAFSEGEQEKCGSETHHTRRNSRWDKRTLEQEDSSSKKRKLL

SEQ ID NO: 77383 - protein, 540 aa, Homo sapiens
  Payload ID: 15439
  Gene Symbol: SENP3-EIF4A1
  Gene Name: SENP3-EIF4A1 readthrough (NMD candidate)
  ENSP ID: ENSP00000483614
DASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTVQGNPPIPTISLLIPSSLAHVQAVSNPSLLQGKTNNI

SEQ ID NO: 77384 - protein, 147 aa, Homo sapiens
  Payload ID: 15440
  Gene Symbol: SNTN
  Gene Name: sentan, cilia apical structure protein
  Uniprot ID: A6NMZ2
  ENSP ID: ENSP00000341442
MGGCMHSTQDKSLHLEGDPNPSAAPTSTCAPRKMPKRISISKQLASVKALRKCSDLEKAIATTALIFRNSSDSDGKLEKAIAKDLLQTQFRNFAEGQETKPKYREILSELDEHTENKLDFEDFMILLLSITVMSDLLQNIRNVKIMK

SEQ ID NO: 77385 - protein, 115 aa, Homo sapiens
  Payload ID: 15440
  Gene Symbol: SNTN
  Gene Name: sentan, cilia apical structure protein
  ENSP ID: ENSP00000419971
MHSTQDKSLHLEGDPNPSAAPTSTCAPRKMPKRISISKQLASVKALRKCSDLEKAIATTALIFRNSSDSDGKLEKAIAKDLLQTQFRNFAEPCEDSRRSWPSAKLEESTLSRHWI

SEQ ID NO: 77386 - protein, 166 aa, Homo sapiens
  Payload ID: 15440
  Gene Symbol: SNTN
  Gene Name: sentan, cilia apical structure protein
  ENSP ID: ENSP00000420078
MGGCMHSTQDKSLHLEGDPNPSAAPTSTCAPRKMPKRISISKQLASVKALRKCSDLEKAIATTALIFRNSSDSDGKLEKAIAKDLLQTQFRNFAELPFTFYHEWKQPEVLTTCRCLILNFPAIRIGQETKPKYREILSELDEHTENKLDFEDFMILLLSITVMSDL

SEQ ID NO: 77387 - protein, 112 aa, Homo sapiens
  Payload ID: 15441
  Gene Symbol: SEPSECS
  Gene Name: Sep (O-phosphoserine) tRNA:Sec (selenocysteine) tRNA synthase
  ENSP ID: ENSP00000351857
MNRESFAAGERLVSPAYVRQGCEARRSHEHLIRLLLEKSLALSPRLECSVTISAHCSLRLPGSRHSPASASRVAGTTGARHHTRASVQRMAGMKVHLNSFYMNLQSWTATIS

SEQ ID NO: 77388 - protein, 501 aa, Homo sapiens
  Payload ID: 15441
  Gene Symbol: SEPSECS
  Gene Name: Sep (O-phosphoserine) tRNA:Sec (selenocysteine) tRNA synthase
  Uniprot ID: Q9HD40
  ENSP ID: ENSP00000371535
MNRESFAAGERLVSPAYVRQGCEARRSHEHLIRLLLEKGKCPENGWDESTLELFLHELAIMDSNNFLGNCGVGEREGRVASALVARRHYRFIHGIGRSGDISAVQPKAAGSSLLNKITNSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDCILCIHSTTSCFAPRVPDRLEELAVICANYDIPHIVNNAYGVQSSKCMHLIQQGARVGRIDAFVQSLDKNFMVPVGGAIIAGFNDSFIQEISKMYPGRASASPSLDVLITLLSLGSNGYKKLLKERKEMFSYLSNQIKKLSEAYNERLLHTPHNPISLAMTLKTLDEHRDKAVTQLGSMLFTRQVSGARVVPLGSMQTVSGYTFRGFMSHTNNYPCAYLNAASAIGMKMQDVDLFIKRLDRCLKAVRKERSKESDDNYDKTEDVDIEEMALKLDNVLLDTYQDASS

SEQ ID NO: 77389 - protein, 47 aa, Homo sapiens
  Payload ID: 15441
  Gene Symbol: SEPSECS
  Gene Name: Sep (O-phosphoserine) tRNA:Sec (selenocysteine) tRNA synthase
  Uniprot ID: Q9HD40
  ENSP ID: ENSP00000421880
MNRESFAAGERLVSPAYVRQGCEARRSHEHLIRLLLEKVHSWHWTIR

SEQ ID NO: 77390 - protein, 177 aa, Homo sapiens [sequence omitted]

SEQ ID NO: 77391 - protein, 95 aa, Homo sapiens
  Payload ID: 15441
  Gene Symbol: SEPSECS
  Gene Name: Sep (O-phosphoserine) tRNA:Sec (selenocysteine) tRNA synthase
  ENSP ID: ENSP00000423850
  MOD_RES (1)..(1): Any amino acid
XKYIIWPRIDQKSCFKSMITAGFEPVVIENVLEGDELRTDLKAVEAKVQELGPDCILCIHSTTSCFAPRVPDRKSFSFTFFRCPYYFIVTWIKWL

SEQ ID NO: 77392 - protein, 261 aa, Homo sapiens
  Payload ID: 15442
  Gene Symbol: SPR
  Gene Name: sepiapterin reductase (7,8-dihydrobiopterin:NADP+ oxidoreductase)
  Uniprot ID: P35270
  ENSP ID: ENSP00000234454
MEGGLGRAVCLLTGASRGFGRTLAPLLASLLSPGSVLVLSARNDEALRQLEAELGAERSGLRVVRVPADLGAEAGLQQLLGALRELPRPKGLQRLLLINNAGSLGDVSKGFVDLSDSTQVNNYWALNLTSMLCLTSSVLKAFPDSPGLNRTVVNISSLCALQPFKGWALYCAGKAARDMLFQVLALEEPNVRVLNYAPGPLDTDMQQLARETSVDPDMRKGLQELKAKGKLVDCKVSAQKLLSLLEKDEFKSGAHVDFYDK

SEQ ID NO: 77393 - protein, 414 aa, Homo sapiens
  Payload ID: 15443
  Gene Symbol: SEPT1
  Gene Name: septin 1
  ENSP ID: ENSP00000324511
MSHHDDGATVGLGIQMCEGWRVEAALSFLPHQRKWGETAGAVMAGGVMDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGLRPLDVAFLRAVHEKVNIIPVIGKADALMPQETQALKQKIRDQLKEEEIHIYQFPECDSDEDEDFKRQDAEMKESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 77394 - protein, 46 aa, Homo sapiens
  Payload ID: 15443
  Gene Symbol: SEPT1
  Gene Name: septin 1
  ENSP ID: ENSP00000456541
MSHHDDGATVGLGIQMCEGWRVEGQGVRGFCCPPQPAAPQVCQEGV

SEQ ID NO: 77395 - protein, 70 aa, Homo sapiens
  Payload ID: 15443
  Gene Symbol: SEPT1
  Gene Name: septin 1
  ENSP ID: ENSP00000459780
MAGGVMDKEYVGFAALPNQLHRKSVKKGFDFTLMVAGESGLGKSTLINSLFLTNLYEDRQVPEASAGFRW

SEQ ID NO: 77396 - protein, 544 aa, Homo sapiens
  Payload ID: 15444
  Gene Symbol: SEPT10
  Gene Name: septin 10
  ENSP ID: ENSP00000349116
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKKEPGCRFELLCIDVRACETNGGRKDAEKAPIFCKTEVPEHRRSSSQANFIKKKLEVCFDFAVICFITSIFGEQPQLLIFMEKYFQVQGQYISQSE

SEQ ID NO: 77397 - protein, 454 aa, Homo sapiens
  Payload ID: 15444
  Gene Symbol: SEPT10
  Gene Name: septin 10
  Uniprot ID: Q9P0V9
  ENSP ID: ENSP00000380824
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 77398 - protein, 431 aa, Homo sapiens
  Payload ID: 15444
  Gene Symbol: SEPT10
  Gene Name: septin 10
  Uniprot ID: Q9P0V9
  ENSP ID: ENSP00000380826
MASSEVARHLKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 77399 - protein, 57 aa, Homo sapiens
  Payload ID: 15444
  Gene Symbol: SEPT10
  Gene Name: septin 10
  ENSP ID: ENSP00000396051
MATKTTCMSSQGSDDEQIKRENIRSLTMSGHVGFESLPDQLVNRSIQQGFCFNILCV

SEQ ID NO: 77400 - protein, 450 aa, Homo sapiens
  Payload ID: 15444
  Gene Symbol: SEPT10
  Gene Name: septin 10
  ENSP ID: ENSP00000396728
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKK

SEQ ID NO: 77401 - protein, 48 aa, Homo sapiens
  Payload ID: 15444
  Gene Symbol: SEPT10
  Gene Name: septin 10
  ENSP ID: ENSP00000399270
MASSEVARHLLFQSHMATKTTCMSSQGSDDEQIVSKHYTSDCQSRYGF

SEQ ID NO: 77402 - protein, 473 aa, Homo sapiens
  Payload ID: 15444
  Gene Symbol: SEPT10
  Gene Name: septin 10
  ENSP ID: ENSP00000407790
MATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKKEPGCRFELLCIDVRACETNGGRKDAEKGREGHSARGQP

SEQ ID NO: 77403 - protein, 61 aa, Homo sapiens
  Payload ID: 15444
  Gene Symbol: SEPT10
  Gene Name: septin 10
  ENSP ID: ENSP00000408392
MLFQSHMATKTTCMSSQGSDDEQIKRENIRSLTMSGHVGFESLPDQLVNRSIQQGFCFNIL

SEQ ID NO: 77404 - protein, 97 aa, Homo sapiens
  Payload ID: 15444
  Gene Symbol: SEPT10
  Gene Name: septin 10
  ENSP ID: ENSP00000416597
MASSEVARHLLFQSHMATKTTCMSSQGSDDEQIVNIIPVIAKADTVSKTELQKFKIKLMSELVSNGVQIYQFPTDDDTIAKVNAAMNGQLPFAVVGS

SEQ ID NO: 77405 - protein, 26 aa, Homo sapiens
  Payload ID: 15444
  Gene Symbol: SEPT10
  Gene Name: septin 10
  ENSP ID: ENSP00000441218
MKNLDSKVNIIPVIAKADTVSKTELQ

SEQ ID NO: 77406 - protein, 98 aa, Homo sapiens
  Payload ID: 15444
  Gene Symbol: SEPT10
  Gene Name: septin 10
  ENSP ID: ENSP00000445707
MKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENEN

SEQ ID NO: 77407 - protein, 38 aa, Homo sapiens
  Payload ID: 15444
  Gene Symbol: SEPT10
  Gene Name: septin 10
  ENSP ID: ENSP00000446331
MASSEVARHLLFQSHMATKTTCMSSQGSDDEQILPTNS

SEQ ID NO: 77408 - protein, 429 aa, Homo sapiens
  Payload ID: 15445
  Gene Symbol: SEPT11
  Gene Name: septin 11
  Uniprot ID: Q9NVA2
  ENSP ID: ENSP00000264893
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 77409 - protein, 372 aa, Homo sapiens
  Payload ID: 15445
  Gene Symbol: SEPT11
  Gene Name: septin 11
  ENSP ID: ENSP00000420839
MNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKK

SEQ ID NO: 77410 - protein, 136 aa, Homo sapiens
  Payload ID: 15445
  Gene Symbol: SEPT11
  Gene Name: septin 11
  ENSP ID: ENSP00000422047
MEERKPAHVLRSFKYAAFMNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFE

SEQ ID NO: 77411 - protein, 439 aa, Homo sapiens
  Payload ID: 15445
  Gene Symbol: SEPT11
  Gene Name: septin 11
  Uniprot ID: Q9NVA2
  ENSP ID: ENSP00000422896
MEERKPAHVLRSFKYAAFMNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 77412 - protein, 160 aa, Homo sapiens
  Payload ID: 15445
  Gene Symbol: SEPT11
  Gene Name: septin 11
  ENSP ID: ENSP00000423103
  MOD_RES (1)..(1): Any amino acid
XLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNPWLCTE

SEQ ID NO: 77413 - protein, 82 aa, Homo sapiens
  Payload ID: 15445
  Gene Symbol: SEPT11
  Gene Name: septin 11
  ENSP ID: ENSP00000424122
RVKEKEAELKEAEKELHEKFDLLKRTHQEEKKKVEDKKKELEEEVNNFQKKKAAAQLLQSQAQQSGAQQTKKDKDKKNFFFM

SEQ ID NO: 77414 - protein, 432 aa, Homo sapiens
  Payload ID: 15445
  Gene Symbol: SEPT11
  Gene Name: septin 11
  ENSP ID: ENSP00000424925
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNSPWLCTE

SEQ ID NO: 77415 - protein, 126 aa, Homo sapiens
  Payload ID: 15445
  Gene Symbol: SEPT11
  Gene Name: septin 11
  ENSP ID: ENSP00000425262
MEERKPAHVLRSFKYAAFMNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKP

SEQ ID NO: 77416 - protein, 425 aa, Homo sapiens
  Payload ID: 15445
  Gene Symbol: SEPT11
  Gene Name: septin 11
  ENSP ID: ENSP00000426344
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKK

SEQ ID NO: 77417 - protein, 358 aa, Homo sapiens
  Payload ID: 15446
  Gene Symbol: SEPT12
  Gene Name: septin 12
  Uniprot ID: Q8IYM1
  ENSP ID: ENSP00000268231
MDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCWDPILGYINEQYEQYLQEEILITRQRHIPDTRVHCCVYFVPPTGHCLRPLDIEFLQRLCRTVNVVPVIARADSLTMEEREAFRRRIQQNLRTHCIDVYPQMCFDEDINDKILNSKLRDRIPFAVVGADQEHLVNGRCVLGRKTKWGIIEVENMAHCEFPLLRDLLIRSHLQDLKDITHNIHYENYRVIRLNESHLLPRGPGWVNLAPASPGQLTTPRTFKVCRGAHDDSDDEF

SEQ ID NO: 77418 - protein, 312 aa, Homo sapiens
  Payload ID: 15446
  Gene Symbol: SEPT12
  Gene Name: septin 12
  Uniprot ID: Q8IYM1
  ENSP ID: ENSP00000379922
MDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCLRPLDIEFLQRLCRTVNVVPVIARADSLTMEEREAFRRRIQQNLRTHCIDVYPQMCFDEDINDKILNSKLRDRIPFAVVGADQEHLVNGRCVLGRKTKWGIIEVENMAHCEFPLLRDLLIRSHLQDLKDITHNIHYENYRVIRLNESHLLPRGPGWVNLAPASPGQLTTPRTFKVCRGAHDDSDDEF

SEQ ID NO: 77419 - protein, 18 aa, Homo sapiens
  Payload ID: 15446
  Gene Symbol: SEPT12
  Gene Name: septin 12
  ENSP ID: ENSP00000464775
  MOD_RES (1)..(1): Any amino acid
XFGDQINNDNWTESLLPW

SEQ ID NO: 77420 - protein, 278 aa, Homo sapiens
  Payload ID: 15446
  Gene Symbol: SEPT12
  Gene Name: septin 12
  ENSP ID: ENSP00000467237
MDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCWDPILGYINEQYEQYLQEEILITRQRHIPDTRVHCCVYFVPPTGHCLRPLDIEFLQRLCRTVNVVPVIARADSLTMEEREAFRRRIQQNLRTHCIDVYPQMCFDEDINDKILNSKLRVRGCGAGGGRGDFLPTHPFHPKTHLSLHLREMCTYS

SEQ ID NO: 77421 - protein, 64 aa, Homo sapiens
  Payload ID: 15446
  Gene Symbol: SEPT12
  Gene Name: septin 12
  ENSP ID: ENSP00000467281
MDPLRRSPSPCLSSQPSSPSTPPCEMLGPVGIEAVLDQLKIKAMKMGFEFNIMVVGQSGLGKST

SEQ ID NO: 77422 - protein, 57 aa, Homo sapiens
  Payload ID: 15446
  Gene Symbol: SEPT12
  Gene Name: septin 12
  ENSP ID: ENSP00000468601
MDPLRRSPSPCLSSQPSSPSTPPCEMLGPVGIEAVLDQLKIKAMKMGFEFNIMVVGE

SEQ ID NO: 77423 - protein, 432 aa, Homo sapiens
  Payload ID: 15447
  Gene Symbol: SEPT14
  Gene Name: septin 14
  Uniprot ID: Q6ZU15
  ENSP ID: ENSP00000373627
MAERTMAMPTQIPADGDTQKENNIRCLTTIGHFGFECLPNQLVSRSIRQGFTFNILCVGETGIGKSTLIDTLFNTNLKDNKSSHFYSNVGLQIQTYELQESNVQLKLTVVETVGYGDQIDKEASYQPIVDYIDAQFEAYLQEELKIKRSLFEYHDSRVHVCLYFISPTGHSLKSLDLLTMKNLDSKVNIIPLIAKADTISKNDLQTFKNKIMSELISNGIQIYQLPTDEETAAQANSSVSGLLPFAVVGSTDEVKVGKRMVRGRHYPWGVLQVENENHCDFVKLRDMLLCTNMENLKEKTHTQHYECYRYQKLQKMGFTDVGPNNQPVSFQEIFEAKRQEFYDQCQREEEELKQRFMQRVKEKEATFKEAEKELQDKFEHLKMIQQEEIRKLEEEKKQLEGEIIDFYKMKAASEALQTQLSTDTKKDKHRKK

SEQ ID NO: 77424 - protein, 361 aa, Homo sapiens
  Payload ID: 15448
  Gene Symbol: SEPT2
  Gene Name: septin 2
  Uniprot ID: Q15019
  ENSP ID: ENSP00000353157
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 77425 - protein, 361 aa, Homo sapiens; identical to SEQ ID NO: 77424
  Payload ID: 15448
  Gene Symbol: SEPT2
  Gene Name: septin 2
  Uniprot ID: Q15019
  ENSP ID: ENSP00000375832

SEQ ID NO: 77426 - protein, 361 aa, Homo sapiens; identical to SEQ ID NO: 77424
  Payload ID: 15448
  Gene Symbol: SEPT2
  Gene Name: septin 2
  Uniprot ID: Q15019
  ENSP ID: ENSP00000375834

SEQ ID NO: 77427 - protein, 321 aa, Homo sapiens
  Payload ID: 15448
  Gene Symbol: SEPT2
  Gene Name: septin 2
  ENSP ID: ENSP00000384525
MVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 77428 - protein, 371 aa, Homo sapiens
  Payload ID: 15448
  Gene Symbol: SEPT2
  Gene Name: septin 2
  Uniprot ID: Q15019
  ENSP ID: ENSP00000385109
MSKQQPTQFINPETPGYVGFANLPNQVHRKSVKKGFEFTLMVVGESGLGKSTLINSLFLTDLYPERVIPGAAALNTRKTLLWEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 77429 - protein, 361 aa, Homo sapiens; identical to SEQ ID NO: 77424
  Payload ID: 15448
  Gene Symbol: SEPT2
  Gene Name: septin 2
  Uniprot ID: Q15019
  ENSP ID: ENSP00000385172

SEQ ID NO: 77430 - protein, 94 aa, Homo sapiens
  Payload ID: 15448
  Gene Symbol: SEPT2
  Gene Name: septin 2
  ENSP ID: ENSP00000386001
MVVGESGLGKSTLINSLFLTDLYPERVIPGAAEKIERTVQIEASTVEIEERGVKLRLTVVDTPGYGDAINCRDWYAPPCPGICICLLNILHKFI

SEQ ID NO: 77431 - protein, 50 aa, Homo sapiens
  Payload ID: 15448
  Gene Symbol: SEPT2
  Gene Name: septin 2
  ENSP ID: ENSP00000389174
MSKQQPTQFINPETPGYVGFANLPNQVHRKSVKKGFEFTLMVVGESGLGK

SEQ ID NO: 77432 - protein, 173 aa, Homo sapiens
  Payload ID: 15448
  Gene Symbol: SEPT2
  Gene Name: septin 2
  ENSP ID: ENSP00000391717
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHN

SEQ ID NO: 77433 - protein, 147 aa, Homo sapiens
  Payload ID: 15448
  Gene Symbol: SEPT2
  Gene Name: septin 2
  ENSP ID: ENSP00000394666
MEFNSNVKSWSFSLQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGL

SEQ ID NO: 77434 - protein, 184 aa, Homo sapiens
  Payload ID: 15448
  Gene Symbol: SEPT2
  Gene Name: septin 2
  ENSP ID: ENSP00000397195
MVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDF

SEQ ID NO: 77435 - protein, 80 aa, Homo sapiens
  Payload ID: 15448
  Gene Symbol: SEPT2
  Gene Name: septin 2
  ENSP ID: ENSP00000397290
MSKQQPTQFINPETPGYVGFANLPNQVHRKSVKKGFEFTLMVVGESGLGKSTLINSLFLTDLYPERVIPGAAVCFFSRKN

SEQ ID NO: 77436 - protein, 121 aa, Homo sapiens
  Payload ID: 15448
  Gene Symbol: SEPT2
  Gene Name: septin 2
  ENSP ID: ENSP00000399195
MVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLK

SEQ ID NO: 77437 - protein, 105 aa, Homo sapiens
  Payload ID: 15448
  Gene Symbol: SEPT2
  Gene Name: septin 2
  ENSP ID: ENSP00000399767
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGY

SEQ ID NO: 77438 - protein, 29 aa, Homo sapiens
  Payload ID: 15448
  Gene Symbol: SEPT2
  Gene Name: septin 2
  ENSP ID: ENSP00000402256
  MOD_RES (1)..(1): Any amino acid
XEMIARMQAQMQMQMQGGDGDGGALGHHV

SEQ ID NO: 77439 - protein, 74 aa, Homo sapiens
  Payload ID: 15448
  Gene Symbol: SEPT2
  Gene Name: septin 2
  ENSP ID: ENSP00000403287
MSKTGVLFCHQAGVQWHDLSSLQLLPPTFKRFPWLSLRSSWDCRHVPPRWLIFWILVNSGFHRVGQDGLDLLTS

SEQ ID NO: 77440 - protein, 22 aa, Homo sapiens
  Payload ID: 15448
  Gene Symbol: SEPT2
  Gene Name: septin 2
  ENSP ID: ENSP00000404417
MSKQQPTQFINPETPGYVGFAN

SEQ ID NO: 77441 - protein, 72 aa, Homo sapiens
  Payload ID: 15448
  Gene Symbol: SEPT2
  Gene Name: septin 2
  ENSP ID: ENSP00000404484
MSKQQPTQFINPETPGYVGFANLPNQVHRKSVKKGFEFTLMVVGESGLGKSTLINSLFLTDLYPERVIPGAA

SEQ ID NO: 77442 - protein, 148 aa, Homo sapiens
  Payload ID: 15448
  Gene Symbol: SEPT2
  Gene Name: septin 2
  ENSP ID: ENSP00000406181
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHC

SEQ ID NO: 77443 - protein, 188 aa, Homo sapiens
  Payload ID: 15448
  Gene Symbol: SEPT2
  Gene Name: septin 2
  ENSP ID: ENSP00000408296
VHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLMKVENEDMNKDQILLEKEAELRRMQEMIARMQAQMQMQMQGGDGDGGALGHHV

SEQ ID NO: 77444 - protein, 161 aa, Homo sapiens
  Payload ID: 15448
  Gene Symbol: SEPT2
  Gene Name: septin 2
  ENSP ID: ENSP00000408902
  MOD_RES (1)..(1): Any amino acid
XSPWYLWRTYLCREAVDSEVTCRKNVSFPLHMLLIFPIKFVSFLEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTL

SEQ ID NO: 77445 - protein, 52 aa, Homo sapiens
  Payload ID: 15448
  Gene Symbol: SEPT2
  Gene Name: septin 2
  ENSP ID: ENSP00000409596
MSKQQPTQFINPETPGYVGFANLPNQVHRKSVKKGFEFTLMVVGESGLGKST

SEQ ID NO: 77446 - protein, 131 aa, Homo sapiens
  Payload ID: 15448
  Gene Symbol: SEPT2
  Gene Name: septin 2
  ENSP ID: ENSP00000412434
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLH

SEQ ID NO: 77447 - protein, 71 aa, Homo sapiens
  Payload ID: 15448
  Gene Symbol: SEPT2
  Gene Name: septin 2
  ENSP ID: ENSP00000413031
MSKQQPTQFINPETPGYVGFANLPNQVHRKSVKKGFEFTLMVVGESGLGKSTLINSLFLTDLYPERVIPGA

SEQ ID NO: 77448 - protein, 396 aa, Homo sapiens
  Payload ID: 15448
  Gene Symbol: SEPT2
  Gene Name: septin 2
  Uniprot ID: Q15019
  ENSP ID: ENSP00000479861
MPWISEGRATRPCLRVPSARRGDEGLHQRDEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 77449 - protein, 83 aa, Homo sapiens
  Payload ID: 15449
  Gene Symbol: SEPT3
  Gene Name: septin 3
  Uniprot ID: Q9UH03
  ENSP ID: ENSP00000379695
MSKGLPETRTDAAMSELVPEPRPKPAVPMKPMSINSNLLGYIGIDTIIEQMRKKTMKTGFDFNIMVVAGSPLRSTSMSSTRSS

SEQ ID NO: 77450 - protein, 350 aa, Homo sapiens
  Payload ID: 15449
  Gene Symbol: SEPT3
  Gene Name: septin 3
  Uniprot ID: Q9UH03
  ENSP ID: ENSP00000379703
MSKGLPETRTDAAMSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPVSVDTEESHDSNP

SEQ ID NO: 77451 - protein, 358 aa, Homo sapiens
  Payload ID: 15449
  Gene Symbol: SEPT3
  Gene Name: septin 3
  Uniprot ID: Q9UH03
  ENSP ID: ENSP00000379704
MSKGLPETRTDAAMSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPGEGLLGTVLPPVPATPCPTAE

SEQ ID NO: 77452 - protein, 294 aa, Homo sapiens
  Payload ID: 15449
  Gene Symbol: SEPT3
  Gene Name: septin 3
  ENSP ID: ENSP00000383956
MSKGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPGEGLLGTVLPPVPATPCPTAE

SEQ ID NO: 77453 - protein, 178 aa, Homo sapiens
  Payload ID: 15449
  Gene Symbol: SEPT3
  Gene Name: septin 3
  ENSP ID: ENSP00000391416
MSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLE

SEQ ID NO: 77454 - protein, 459 aa, Homo sapiens
  Payload ID: 15450
  Gene Symbol: SEPT4
  Gene Name: septin 4
  Uniprot ID: O43236
  ENSP ID: ENSP00000321071
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 77455 - protein, 478 aa, Homo sapiens
  Payload ID: 15450
  Gene Symbol: SEPT4
  Gene Name: septin 4
  Uniprot ID: O43236
  ENSP ID: ENSP00000321674
MDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 77456 - protein, 459 aa, Homo sapiens; identical to SEQ ID NO: 77454
  Payload ID: 15450
  Gene Symbol: SEPT4
  Gene Name: septin 4
  Uniprot ID: O43236
  ENSP ID: ENSP00000376801

SEQ ID NO: 77457 - protein, 493 aa, Homo sapiens
  Payload ID: 15450
  Gene Symbol: SEPT4
  Gene Name: septin 4
  Uniprot ID: O43236
  ENSP ID: ENSP00000402000
MRSSPALFSSRAAPQKPRKEGSQAAGLLVFSDSLEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 77458 - protein, 274 aa, Homo sapiens
  Payload ID: 15450
  Gene Symbol: SEPT4
  Gene Name: septin 4
  Uniprot ID: O43236
  ENSP ID: ENSP00000402348
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCH

SEQ ID NO: 77459 - protein, 470 aa, Homo sapiens
  Payload ID: 15450
  Gene Symbol: SEPT4
  Gene Name: septin 4
  Uniprot ID: O43236
  ENSP ID: ENSP00000414779
MPGFYSVMTDEEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 77460 - protein, 55 aa, Homo sapiens
  Payload ID: 15450
  Gene Symbol: SEPT4
  Gene Name: septin 4
  ENSP ID: ENSP00000462278
MDRSLGWQGNSVPEDRTEAGIKRFLEDTTDDGELSKMTRSMWALQPSPTKSTESP

SEQ ID NO: 77461 - protein, 36 aa, Homo sapiens
  Payload ID: 15450
  Gene Symbol: SEPT4
  Gene Name: septin 4
  ENSP ID: ENSP00000462362
MIKRFLEDTTDDGELSKMTRSMWALQPSPTKSTESP

SEQ ID NO: 77462 - protein, 379 aa, Homo sapiens
  Payload ID: 15450
  Gene Symbol: SEPT4
  Gene Name: septin 4
  ENSP ID: ENSP00000462727
MDRSLGWQGNSVPEDRTEAGDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 77463 - protein, 225 aa, Homo sapiens
  Payload ID: 15450
  Gene Symbol: SEPT4
  Gene Name: septin 4
  ENSP ID: ENSP00000463461
MGPVPTSFGKRRGGPQTLPASPGGMIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTE

SEQ ID NO: 77464 - protein, 207 aa, Homo sapiens
  Payload ID: 15450
  Gene Symbol: SEPT4
  Gene Name: septin 4
  ENSP ID: ENSP00000463671
MGPVPTSFGKRRGGPQTLPASPGGMDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDH

SEQ ID NO: 77465 - protein, 331 aa, Homo sapiens
  Payload ID: 15450
  Gene Symbol: SEPT4
  Gene Name: septin 4
  Uniprot ID: O43236
  ENSP ID: ENSP00000463768
MVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 77466 - protein, 72 aa, Homo sapiens
  Payload ID: 15450
  Gene Symbol: SEPT4
  Gene Name: septin 4
  ENSP ID: ENSP00000464360
MIKRFLEDTTDDGELSKFVKDFSGNASCHPPEAKTWASRPQVPEPRPQAPDLYDDDLEFRPPSRPQSSDNQQ

SEQ ID NO: 77467 - protein, 332 aa, Homo sapiens
  Payload ID: 15450
  Gene Symbol: SEPT4
  Gene Name: septin 4
  ENSP ID: ENSP00000464373
MDRSLGWQGNSVPEDRTEAGDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRKDRSRN

SEQ ID NO: 77468 - protein, 175 aa, Homo sapiens
  Payload ID: 15450
  Gene Symbol: SEPT4
  Gene Name: septin 4
  ENSP ID: ENSP00000464382
MDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCH

SEQ ID NO: 77469 - protein, 378 aa, Homo sapiens
  Payload ID: 15451
  Gene Symbol: SEPT5
  Gene Name: septin 5
  ENSP ID: ENSP00000372515
MDSLAAPQDRLVEQLLSPRTQAQRRLKDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 77470 - protein, 180 aa, Homo sapiens
  Payload ID: 15451
  Gene Symbol: SEPT5
  Gene Name: septin 5
  ENSP ID: ENSP00000378541
MVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDE

SEQ ID NO: 77471 - protein, 337 aa, Homo sapiens
  Payload ID: 15451
  Gene Symbol: SEPT5
  Gene Name: septin 5
  ENSP ID: ENSP00000384535
MSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEGALRLREAAQHAHPHAYARPQGRDVRRALRELPRALHPADDQQTDPGQPHGEPHPDPAAAHPGRRD

SEQ ID NO: 77472 - protein, 248 aa, Homo sapiens
  Payload ID: 15451
  Gene Symbol: SEPT5
  Gene Name: septin 5
  ENSP ID: ENSP00000385356
MSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKWRTRRIATS

SEQ ID NO: 77473 - protein, 369 aa, Homo sapiens
  Payload ID: 15451
  Gene Symbol: SEPT5
  Gene Name: septin 5
  Uniprot ID: Q99719
  ENSP ID: ENSP00000391311
MSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 77474 - protein, 378 aa, Homo sapiens; identical to SEQ ID NO: 77469
  Payload ID: 15451
  Gene Symbol: SEPT5
  Gene Name: septin 5
  ENSP ID: ENSP00000391731

SEQ ID NO: 77475 - protein, 346 aa, Homo sapiens
  Payload ID: 15451
  Gene Symbol: SEPT5
  Gene Name: septin 5
  Uniprot ID: Q99719
  ENSP ID: ENSP00000394541
MDSLAAPQDRLVEQLLSPRTQAQRRLKDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEGALRLREAAQHAHPHAYARPQGRDVRRALRELPRALHPADDQQTDPGQPHGEPHPDPAAAHPGRRD

SEQ ID NO: 77476 - protein, 322 aa, Homo sapiens
  Payload ID: 15451
  Gene Symbol: SEPT5
  Gene Name: septin 5
  ENSP ID: ENSP00000399685
MVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMKDEELRRMQEMLQRMKQQMQDQ

SEQ ID NO: 77477 - protein, 106 aa, Homo sapiens
  Payload ID: 15451
  Gene Symbol: SEPT5
  Gene Name: septin 5
  ENSP ID: ENSP00000404673
  MOD_RES (1)..(1): Any amino acid
XTIVDTPGFGDAVNNTECWKPITDYVDQQFEQYFRDESGLNRKNIQDNRVHCCLYFISPFGHGEIRKLKERIREEIDKFGIHVYQFPECDSDEDEDFKQQDRELKV

SEQ ID NO: 77478 - protein, 301 aa, Homo sapiens
  Payload ID: 15451
  Gene Symbol: SEPT5
  Gene Name: septin 5
  ENSP ID: ENSP00000408678
MVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEVENQAHCDFVKLRNMLIRTHMHDLKDVTCDVHYENYRAHCIQQMTSKLTQDSRMESPIPILPLPTPDAETEKLIRMK

SEQ ID NO: 77479 - protein, 304 aa, Homo sapiens
  Payload ID: 15451
  Gene Symbol: SEPT5
  Gene Name: septin 5
  ENSP ID: ENSP00000414488
MSCSAGLACWDSTGVMEVGGPQSGARETPAVPGVATWEGGPAGRSSQSLQSCGSELDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYP

SEQ ID NO: 77480 - protein, 178 aa, Homo sapiens
  Payload ID: 15451
  Gene Symbol: SEPT5
  Gene Name: septin 5
  ENSP ID: ENSP00000480620
MSTGLRYKSKLATPEDKQDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDGFHEGIA

SEQ ID NO: 77481 - protein, 434 aa, Homo sapiens
  Payload ID: 15452
  Gene Symbol: SEPT6
  Gene Name: septin 6
  Uniprot ID: Q14141
  ENSP ID: ENSP00000341524
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNNPWLCTE

SEQ ID NO: 77482 - protein, 429 aa, Homo sapiens
  Payload ID: 15452
  Gene Symbol: SEPT6
  Gene Name: septin 6
  Uniprot ID: Q14141
  ENSP ID: ENSP00000346169
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNFF

SEQ ID NO: 77483 - protein, 431 aa, Homo sapiens
  Payload ID: 15452
  Gene Symbol: SEPT6
  Gene Name: septin 6
  ENSP ID: ENSP00000346397
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKNLGFL

SEQ ID NO: 77484 - protein, 427 aa, Homo sapiens
  Payload ID: 15452
  Gene Symbol: SEPT6
  Gene Name: septin 6
  Uniprot ID: Q14141
  ENSP ID: ENSP00000353278
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKN

SEQ ID NO: 77485 - protein, 427 aa, Homo sapiens; identical to SEQ ID NO: 77484
  Payload ID: 15452
  Gene Symbol: SEPT6
  Gene Name: septin 6
  Uniprot ID: Q14141
  ENSP ID: ENSP00000378108

SEQ ID NO: 77486 - protein, 427 aa, Homo sapiens; identical to SEQ ID NO: 77484
  Payload ID: 15452
  Gene Symbol: SEPT6
  Gene Name: septin 6
  Uniprot ID: Q14141
  ENSP ID: ENSP00000418715

SEQ ID NO: 77487 - protein, 267 aa, Homo sapiens
  Payload ID: 15452
  Gene Symbol: SEPT6
  Gene Name: septin 6
  Uniprot ID: Q14141
  ENSP ID: ENSP00000435818
MAATDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQAAREV

SEQ ID NO: 77488 - protein, 437 aa, Homo sapiens
  Payload ID: 15453
  Gene Symbol: SEPT7
  Gene Name: septin 7
  ENSP ID: ENSP00000344868
MSVSARSAAAEERSVNSSTMGQQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 77489 - protein, 384 aa, Homo sapiens
  Payload ID: 15453
  Gene Symbol: SEPT7
  Gene Name: septin 7
  Uniprot ID: Q16181
  ENSP ID: ENSP00000381992
MVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 77490 - protein, 417 aa, Homo sapiens
  Payload ID: 15453
  Gene Symbol: SEPT7
  Gene Name: septin 7
  ENSP ID: ENSP00000381993
MKQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 77491 - protein, 401 aa, Homo sapiens
  Payload ID: 15453
  Gene Symbol: SEPT7
  Gene Name: septin 7
  ENSP ID: ENSP00000413507
MSVSARSAAAEERSVNSSTMGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 77492 - protein, 88 aa, Homo sapiens
  Payload ID: 15453
  Gene Symbol: SEPT7
  Gene Name: septin 7
  ENSP ID: ENSP00000444240
MKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 77493 - protein, 76 aa, Homo sapiens
  Payload ID: 15453
  Gene Symbol: SEPT7
  Gene Name: septin 7
  ENSP ID: ENSP00000489044
MSVSARSAAAEERSVNSSTMAQQKNLEGYVGFANLPNQVYRKSVKRGFEFTLMVVGESGLGKSTLINSLFLTDLYS

SEQ ID NO: 77494 - protein, 46 aa, Homo sapiens
  Payload ID: 15453
  Gene Symbol: SEPT7
  Gene Name: septin 7
  ENSP ID: ENSP00000489192
SARSAAAEERSVNSSTMVPLWISSVGIWNTGMMEMCSLQSSSTEEP

SEQ ID NO: 77495 - protein, 77 aa, Homo sapiens
  Payload ID: 15453
  Gene Symbol: SEPT7
  Gene Name: septin 7
  ENSP ID: ENSP00000489466
MSVSARSAAAEERSVNSSTMVAQQKNLEGYVGFANLPNQVYRKSVKRGFEFTLMVVGESGLGKSTLINSLFLTDLYS

SEQ ID NO: 77496 - protein, 157 aa, Homo sapiens
  Payload ID: 15453
  Gene Symbol: SEPT7
  Gene Name: septin 7
  ENSP ID: ENSP00000489480
MVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQ

SEQ ID NO: 77497 - protein, 147 aa, Homo sapiens
  Payload ID: 15453
  Gene Symbol: SEPT7
  Gene Name: septin 7
  ENSP ID: ENSP00000489538
MVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLT

SEQ ID NO: 77498 - protein, 111 aa, Homo sapiens
  Payload ID: 15453
  Gene Symbol: SEPT7
  Gene Name: septin 7
  ENSP ID: ENSP00000489596
VTYNGVDNNKNKGQLTKHLMITLNIRDRSPLAQMEEERREHVAKMKKMEMEMEQVFEMKVKEKVQKLKDSEAELQRRHEQMKKNLEAQHKELEEKRRQFEDEKANWEAQQR

SEQ ID NO: 77499 - protein, 429 aa, Homo sapiens
  Payload ID: 15454
  Gene Symbol: SEPT8
  Gene Name: septin 8
  Uniprot ID: Q92599
  ENSP ID: ENSP00000296873
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKN

SEQ ID NO: 77500 - protein, 78 aa, Homo sapiens
  Payload ID: 15454
  Gene Symbol: SEPT8
  Gene Name: septin 8
  ENSP ID: ENSP00000360548
MNTLFNTTFETEEASHHEACVRLRPQTYDLQESNVQLKLTIVDAVGFGDQINKDESYRPIVDYIDAQFENYLQEELKI

SEQ ID NO: 77501 - protein, 369 aa, Homo sapiens
  Payload ID: 15454
  Gene Symbol: SEPT8
  Gene Name: septin 8
  Uniprot ID: Q92599
  ENSP ID: ENSP00000367971
MNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKN

SEQ ID NO: 77502 - protein, 440 aa, Homo sapiens
  Payload ID: 15454
  Gene Symbol: SEPT8
  Gene Name: septin 8
  ENSP ID: ENSP00000367973
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDERPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKKASGWSSIYSVTIP

SEQ ID NO: 77503 - protein, 430 aa, Homo sapiens
  Payload ID: 15454
  Gene Symbol: SEPT8
  Gene Name: septin 8
  ENSP ID: ENSP00000367978
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKKS

SEQ ID NO: 77504 - protein, 483 aa, Homo sapiens
  Payload ID: 15454
  Gene Symbol: SEPT8
  Gene Name: septin 8
  Uniprot ID: Q92599
  ENSP ID: ENSP00000367991
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKNRSDIGAHQPGMSLSSSKVMMTKASVEPLNCSSWWPAIQCCSCLVRDATWREGFL

SEQ ID NO: 77505 - protein, 460 aa, Homo sapiens
  Payload ID: 15454
  Gene Symbol: SEPT8
  Gene Name: septin 8
  ENSP ID: ENSP00000367993
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDERPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKKGLSWISSQNPAHIHSHLVKQQMSSSSSPKAWDA

SEQ ID NO: 77506 - protein, 442 aa, Homo sapiens
  Payload ID: 15454
  Gene Symbol: SEPT8
  Gene Name: septin 8
  Uniprot ID: Q92599
  ENSP ID: ENSP00000394766
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDESYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKKASGWSSIYSVTIP

SEQ ID NO: 77507 - protein, 369 aa, Homo sapiens; identical to SEQ ID NO: 77501
  Payload ID: 15454
  Gene Symbol: SEPT8
  Gene Name: septin 8
  Uniprot ID: Q92599
  ENSP ID: ENSP00000399840

SEQ ID NO: 77508 - protein, 130 aa, Homo sapiens
  Payload ID: 15454
  Gene Symbol: SEPT8
  Gene Name: septin 8
  ENSP ID: ENSP00000407421
MNTLFNTTFETEEASHHEACVRLRPQTYDLQESNVQLKLTIVDAVGFGDQINKDERPIVDYIDAQFENYLQEELKIRRSLFDYHDTRIHVCLYFITPTGHSLKSLDLVTMKKLDSKVNIIPIIAKADTIS

SEQ ID NO: 77509 - protein, 97 aa, Homo sapiens
  Payload ID: 15454
  Gene Symbol: SEPT8
  Gene Name: septin 8
  ENSP ID: ENSP00000411823
MNTLFNTTFETEEASHHEACVRLRPQTYDLQESNVQLKLTIVDAVGFGDQINKDESYRPIVDYIDAQFENYLQEELKIRRSLFDYHDTRIHVCLYFI

SEQ ID NO: 77510 - protein, 426 aa, Homo sapiens
  Payload ID: 15454
  Gene Symbol: SEPT8
  Gene Name: septin 8
  ENSP ID: ENSP00000483876
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVSGEGVSCLYRPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKN

SEQ ID NO: 77511 - protein, 568 aa, Homo sapiens
  Payload ID: 15455
  Gene Symbol: SEPT9
  Gene Name: septin 9
  Uniprot ID: Q9UHD8
  ENSP ID: ENSP00000329161
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 77512 - protein, 586 aa, Homo sapiens
  Payload ID: 15455
  Gene Symbol: SEPT9
  Gene Name: septin 9
  Uniprot ID: Q9UHD8
  ENSP ID: ENSP00000391249
MKKSYSGGTRTSSGRLRRLGDSSGPALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 77513 - protein, 422 aa, Homo sapiens
  Payload ID: 15455
  Gene Symbol: SEPT9
  Gene Name: septin 9
  Uniprot ID: Q9UHD8
  ENSP ID: ENSP00000400181
MEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 77514 - protein, 422 aa, Homo sapiens; identical to SEQ ID NO: 77513
  Payload ID: 15455
  Gene Symbol: SEPT9
  Gene Name: septin 9
  Uniprot ID: Q9UHD8
  ENSP ID: ENSP00000403194

SEQ ID NO: 77515 - protein, 579 aa, Homo sapiens
  Payload ID: 15455
  Gene Symbol: SEPT9
  Gene Name: septin 9
  Uniprot ID: Q9UHD8
  ENSP ID: ENSP00000405877
MSDPAVNAQLDGIISDFEALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 77516 - protein, 422 aa, Homo sapiens; identical to SEQ ID NO: 77513
  Payload ID: 15455
  Gene Symbol: SEPT9
  Gene Name: septin 9
  Uniprot ID: Q9UHD8
  ENSP ID: ENSP00000406987

SEQ ID NO: 77517 - protein, 474 aa, Homo sapiens
  Payload ID: 15455
  Gene Symbol: SEPT9
  Gene Name: septin 9
  Uniprot ID: Q9UHD8
  ENSP ID: ENSP00000415624
MGSSFWEGLQVAVGLPQGCWPQGLDSGEPAEGGQLEAAPVCIVTRQSKETAGPTLGRGGWRQGSLRRGKGTSCRCRQLSPGHGPGRLTGCGECHRLPCRGLVSGFTGLRGQEEDDLAFCLATIGSDRQATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 77518 - protein, 335 aa, Homo sapiens
  Payload ID: 15455
  Gene Symbol: SEPT9
  Gene Name: septin 9
  Uniprot ID: Q9UHD8
  ENSP ID: ENSP00000438089
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 77519 - protein, 209 aa, Homo sapiens
  Payload ID: 15455
  Gene Symbol: SEPT9
  Gene Name: septin 9
  ENSP ID: ENSP00000464832
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQR

SEQ ID NO: 77520 - protein, 134 aa, Homo sapiens
  Payload ID: 15455
  Gene Symbol: SEPT9
  Gene Name: septin 9
  ENSP ID: ENSP00000465026
MKDFGSRQEFDSVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQE

SEQ ID NO: 77521 - protein, 125 aa, Homo sapiens
  Payload ID: 15455
  Gene Symbol: SEPT9
  Gene Name: septin 9
  ENSP ID: ENSP00000465332
MIICPTRPFTALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGH

SEQ ID NO: 77522 - protein, 195 aa, Homo sapiens
  Payload ID: 15455
  Gene Symbol: SEPT9
  Gene Name: septin 9
  ENSP ID: ENSP00000465415
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKA

SEQ ID NO: 77523 - protein, 568 aa, Homo sapiens; identical to SEQ ID NO: 77511
  Payload ID: 15455
  Gene Symbol: SEPT9
  Gene Name: septin 9
  Uniprot ID: Q9UHD8
  ENSP ID: ENSP00000465464

SEQ ID NO: 77524 - protein, 23 aa, Homo sapiens
  Payload ID: 15455
  Gene Symbol: SEPT9
  Gene Name: septin 9
  ENSP ID: ENSP00000465600
MHLAAEHCVCDSPPSSWNHPPQV

SEQ ID NO: 77525 - protein, 209 aa, Homo sapiens; identical to SEQ ID NO: 77519
  Payload ID: 15455
  Gene Symbol: SEPT9
  Gene Name: septin 9
  ENSP ID: ENSP00000465904

SEQ ID NO: 77526 - protein, 144 aa, Homo sapiens
  Payload ID: 15455
  Gene Symbol: SEPT9
  Gene Name: septin 9
  ENSP ID: ENSP00000466115
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEV

SEQ ID NO: 77527 - protein, 159 aa, Homo sapiens
  Payload ID: 15455
  Gene Symbol: SEPT9
  Gene Name: septin 9
  ENSP ID: ENSP00000466164
MGSFRTSKMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEI

SEQ ID NO: 77528 - protein, 107 aa, Homo sapiens
  Payload ID: 15455
  Gene Symbol: SEPT9
  Gene Name: septin 9
  ENSP ID: ENSP00000466170
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKL

SEQ ID NO: 77529 - protein, 135 aa, Homo sapiens
  Payload ID: 15455
  Gene Symbol: SEPT9
  Gene Name: septin 9
  ENSP ID: ENSP00000466201
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQ

SEQ ID NO: 77530 - protein, 335 aa, Homo sapiens; identical to SEQ ID NO: 77518
  Payload ID: 15455
  Gene Symbol: SEPT9
  Gene Name: septin 9
  Uniprot ID: Q9UHD8
  ENSP ID: ENSP00000466247

SEQ ID NO: 77531 - protein, 104 aa, Homo sapiens
  Payload ID: 15455
  Gene Symbol: SEPT9
  Gene Name: septin 9
  ENSP ID: ENSP00000466532
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVR

SEQ ID NO: 77532 - protein, 335 aa, Homo sapiens; identical to SEQ ID NO: 77518
  Payload ID: 15455
  Gene Symbol: SEPT9
  Gene Name: septin 9
  Uniprot ID: Q9UHD8
  ENSP ID: ENSP00000466648

SEQ ID NO: 77533 - protein, 44 aa, Homo sapiens
  Payload ID: 15455
  Gene Symbol: SEPT9
  Gene Name: septin 9
  ENSP ID: ENSP00000466684
MKKSYSDLLLDPCISNLASLHCARFSGARHRRICSCLVIFDSAR

SEQ ID NO: 77534 - protein, 152 aa, Homo sapiens
  Payload ID: 15455
  Gene Symbol: SEPT9
  Gene Name: septin 9
  ENSP ID: ENSP00000466997
MTSMSAGTINTLKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEP

SEQ ID NO: 77535 - protein, 189 aa, Homo sapiens
  Payload ID: 15455
  Gene Symbol: SEPT9
  Gene Name: septin 9
  ENSP ID: ENSP00000467051
MPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGESSPCMPLNQCRKPASAPRAAHKPLGLVFPSVKWGSNPDLKDGLPVTLRVHACAWEEPTASSGSSEGPVLHIQGP

SEQ ID NO: 77536 - protein, 57 aa, Homo sapiens
  Payload ID: 15455
  Gene Symbol: SEPT9
  Gene Name: septin 9
  ENSP ID: ENSP00000467619
MADTPRDAGLKQAPASRNEKAPVDFGYVGIDSILEQMRRKAMKQGFEFNIMVVERLG

SEQ ID NO: 77537 - protein, 165 aa, Homo sapiens
  Payload ID: 15455
  Gene Symbol: SEPT9
  Gene Name: septin 9
  ENSP ID: ENSP00000467780
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIP

SEQ ID NO: 77538 - protein, 115 aa, Homo sapiens
  Payload ID: 15455
  Gene Symbol: SEPT9
  Gene Name: septin 9
  ENSP ID: ENSP00000467792
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGF

SEQ ID NO: 77539 - protein, 157 aa, Homo sapiens
  Payload ID: 15455
  Gene Symbol: SEPT9
  Gene Name: septin 9
  ENSP ID: ENSP00000467908
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRV

SEQ ID NO: 77540 - protein, 90 aa, Homo sapiens
  Payload ID: 15455
  Gene Symbol: SEPT9
  Gene Name: septin 9
  ENSP ID: ENSP00000468090
MKDFGSRQEFDSVENAGAIGPSRFGLKRAEVLGHKTPEPAPRRTEITIVKPQESAHRRMEPPASKPEVGAAHLRGAHPQDHRDQVHHARY

SEQ ID NO: 77541 - protein, 151 aa, Homo sapiens
  Payload ID: 15455
  Gene Symbol: SEPT9
  Gene Name: septin 9
  ENSP ID: ENSP00000468110
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKR

SEQ ID NO: 77542 - protein, 362 aa, Homo sapiens
  Payload ID: 15455
  Gene Symbol: SEPT9
  Gene Name: septin 9
  Uniprot ID: Q9UHD8
  ENSP ID: ENSP00000468120
MAGAGCTGTWSWLWGTATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 77543 - protein, 35 aa, Homo sapiens
  Payload ID: 15455
  Gene Symbol: SEPT9
  Gene Name: septin 9
  ENSP ID: ENSP00000468244
MEPPASKVPEVPTAPATDAAPKRVEIQMPKPAEAP

SEQ ID NO: 77544 - protein, 567 aa, Homo sapiens
  Payload ID: 15455
  Gene Symbol: SEPT9
  Gene Name: septin 9
  Uniprot ID: Q9UHD8
  ENSP ID: ENSP00000468406
MKKSYSALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 77545 - protein, 127 aa, Homo sapiens
  Payload ID: 15455
  Gene Symbol: SEPT9
  Gene Name: septin 9
  ENSP ID: ENSP00000468410
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQP

SEQ ID NO: 77546 - protein, 151 aa, Homo sapiens
  Payload ID: 15455
  Gene Symbol: SEPT9
  Gene Name: septin 9
  ENSP ID: ENSP00000468504
MLWPEEEPWGGRCACVTEACPADAGPLTSRRGSLKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPE

SEQ ID NO: 77547 - protein, 422 aa, Homo sapiens; identical to SEQ ID NO: 77513
  Payload ID: 15455
  Gene Symbol: SEPT9
  Gene Name: septin 9
  Uniprot ID: Q9UHD8
  ENSP ID: ENSP00000468668

SEQ ID NO: 77548 - protein, 10 aa, Homo sapiens
  Payload ID: 15455
  Gene Symbol: SEPT9
  Gene Name: septin 9
  ENSP ID: ENSP00000487985
MIICPTRPFT

SEQ ID NO: 77549 - protein, 6 aa, Homo sapiens
  Payload ID: 15455
  Gene Symbol: SEPT9
  Gene Name: septin 9
  ENSP ID: ENSP00000488209
MKKSYS

SEQ ID NO: 77550 - protein, 44 aa, Homo sapiens; identical to SEQ ID NO: 77533
  Payload ID: 15455
  Gene Symbol: SEPT9
  Gene Name: septin 9
  ENSP ID: ENSP00000488513

SEQ ID NO: 77551 - protein, 6 aa, Homo sapiens
  Payload ID: 15455
  Gene Symbol: SEPT9
  Gene Name: septin 9
  ENSP ID: ENSP00000488820
MKKSYS

SEQ ID NO: 77552 - protein, 356 aa, Homo sapiens
  Payload ID: 15456
  Gene Symbol: SQSTM1
  Gene Name: sequestosome 1
  Uniprot ID: Q13501
  ENSP ID: ENSP00000353944
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 77553 - protein, 440 aa, Homo sapiens
  Payload ID: 15456
  Gene Symbol: SQSTM1
  Gene Name: sequestosome 1
  Uniprot ID: Q13501
  ENSP ID: ENSP00000374455
MASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 77554 - protein, 140 aa, Homo sapiens
  Payload ID: 15456
  Gene Symbol: SQSTM1
  Gene Name: sequestosome 1
  ENSP ID: ENSP00000394534
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAES

SEQ ID NO: 77555 - protein, 73 aa, Homo sapiens
  Payload ID: 15456
  Gene Symbol: SQSTM1
  Gene Name: sequestosome 1
  ENSP ID: ENSP00000405061
MASLTVKAYLLGKEDAAREIRRFSFCCSPEPEAEAEAAAGPGPCERLLSRVAALFPALRPGGFQAHYRGGGFR

SEQ ID NO: 77556 - protein, 69 aa, Homo sapiens
  Payload ID: 15456
  Gene Symbol: SQSTM1
  Gene Name: sequestosome 1
  ENSP ID: ENSP00000424195
MASLTVKAYLLGKEDAAREIRRFSFCCSPEPEAEAEAAAGPGPCERLLSRVAALFPALRPGGFQAHYRG

SEQ ID NO: 77557 - protein, 378 aa, Homo sapiens
  Payload ID: 15456
  Gene Symbol: SQSTM1
  Gene Name: sequestosome 1
  ENSP ID: ENSP00000424477
MASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALECCPWASLMKAAGSPGSCRPRTMTSERLWTPSSIQSIPRRCDHFCPPLLRAPLLSHSCVKLA

SEQ ID NO: 77558 - protein, 190 aa, Homo sapiens
  Payload ID: 15456
  Gene Symbol: SQSTM1
  Gene Name: sequestosome 1
  ENSP ID: ENSP00000425957
MASLTVKAYLLGKEDAAREIRRFSFCCSPEPEAEAEAAAGPGPCERLLSRVAALFPALRPGGFQAHYRAHSSSLCPAENPWVLTCCLLNNLDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLA

SEQ ID NO: 77559 - protein, 167 aa, Homo sapiens
  Payload ID: 15456
  Gene Symbol: SQSTM1
  Gene Name: sequestosome 1
  ENSP ID: ENSP00000427308
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPL

SEQ ID NO: 77560 - protein, 73 aa, Homo sapiens; identical to SEQ ID NO: 77555
  Payload ID: 15456
  Gene Symbol: SQSTM1
  Gene Name: sequestosome 1
  ENSP ID: ENSP00000487071

SEQ ID NO: 77561 - protein, 158 aa, Homo sapiens
  Payload ID: 15457
  Gene Symbol: SRGN
  Gene Name: serglycin
  Uniprot ID: P10124
  ENSP ID: ENSP00000242465
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 77562 - protein, 531 aa, Homo sapiens
  Payload ID: 15458
  Gene Symbol: SERAC1
  Gene Name: serine active site containing 1
  Uniprot ID: Q96JX3
  ENSP ID: ENSP00000356068
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKGGLWCFGGNGLPYAESFGEVPSATVEMFCLEAIVKHSEISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKTWLAKDCPALRIISVEYDTSLSDWRARCPMERRSLLSISSGIVEGLESPLHSEATNFLGSSELLVLGIGQWFGYHIAWEVFLSKRCCWKPLRSQK

SEQ ID NO: 77563 - protein, 654 aa, Homo sapiens
  Payload ID: 15458
  Gene Symbol: SERAC1
  Gene Name: serine active site containing 1
  Uniprot ID: Q96JX3
  ENSP ID: ENSP00000356071
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKGGLWCFGGNGLPYAESFGEVPSATVEMFCLEAIVKHSEISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKTWLAKDCPALRIISVEYDTSLSDWRARCPMERKSIAFRSNELLRKLRAAGVGDRPVVWISHSMGGLLVKKMLLEASTKPEMSTVINNTRGIIFYSVPHHGSRLAEYSVNIRYLLFPSLEVKELSKDSPALKTLQDDFLEFAKDKNFQVLNFVETLPTYIGSMIKLHVVPVESADLGIGDLIPVDVNHLNICKPKKKDAFLYQRTLQFIREALAKDLEN

SEQ ID NO: 77564 - protein, 162 aa, Homo sapiens
  Payload ID: 15458
  Gene Symbol: SERAC1
  Gene Name: serine active site containing 1
  ENSP ID: ENSP00000391168
DEDRYTTCWPKTWLAKDCPALRIISVEYDTSLSDWRARCPMERKSIAFRSNELLRKLRAAGVGDRPVVWISHSMGGLLVKKMLLEASTKPEMSTVINNTRGIIFYSVPHHGSRLAEYSVNIRYLLFPSLEVKELSKGNTFCHKGNWGYINISYTEKKKKFLP

SEQ ID NO: 77565 - protein, 42 aa, Homo sapiens
  Payload ID: 15458
  Gene Symbol: SERAC1
  Gene Name: serine active site containing 1
  ENSP ID: ENSP00000475523
MSLAAYCVICCRRIGTSTSPPKSGTHWRDIKVLYFLHMKFWP

SEQ ID NO: 77566 - protein, 167 aa, Homo sapiens
  Payload ID: 15458
  Gene Symbol: SERAC1
  Gene Name: serine active site containing 1
  Uniprot ID: Q96JX3
  ENSP ID: ENSP00000475788
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHGNETT

SEQ ID NO: 77567 - protein, 409 aa, Homo sapiens
  Payload ID: 15458
  Gene Symbol: SERAC1
  Gene Name: serine active site containing 1
  ENSP ID: ENSP00000475808
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKKVHCIQKQRTS

SEQ ID NO: 77568 - protein, 42 aa, Homo sapiens; identical to SEQ ID NO: 77565
  Payload ID: 15458
  Gene Symbol: SERAC1
  Gene Name: serine active site containing 1
  ENSP ID: ENSP00000475855

SEQ ID NO: 77569 - protein, 452 aa, Homo sapiens
  Payload ID: 15459
  Gene Symbol: SCPEP1
  Gene Name: serine carboxypeptidase 1
  Uniprot ID: Q9HB40
  ENSP ID: ENSP00000262288
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKIIPEDQSWGGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 77570 - protein, 296 aa, Homo sapiens
  Payload ID: 15459
  Gene Symbol: SCPEP1
  Gene Name: serine carboxypeptidase 1
  Uniprot ID: Q9HB40
  ENSP ID: ENSP00000458587
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVWF

SEQ ID NO: 77571 - protein, 69 aa, Homo sapiens
  Payload ID: 15459
  Gene Symbol: SCPEP1
  Gene Name: serine carboxypeptidase 1
  ENSP ID: ENSP00000458671
MELALRRSPVPRWLLLLPLLLGLNAGSMGLCDGPQGCLHVLVALLCHQLLQELLRTAPGHVASGRSRRF

SEQ ID NO: 77572 - protein, 147 aa, Homo sapiens
  Payload ID: 15459
  Gene Symbol: SCPEP1
  Gene Name: serine carboxypeptidase 1
  ENSP ID: ENSP00000459807
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPFSEGPSSATLRGLPWVIPGSPLLIRCSPGDLTCTACLFSKTKVWQRCLRLQSKY

SEQ ID NO: 77573 - protein, 176 aa, Homo sapiens
  Payload ID: 15459
  Gene Symbol: SCPEP1
  Gene Name: serine carboxypeptidase 1
  ENSP ID: ENSP00000461663
MELALRRSPVPRWLLLLPLLLGLNAGAVIDWPTEEGKEVWDYVTVRKDAYMFWWLYYATNSCKNFSELPLVMWLQLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPV

SEQ ID NO: 77574 - protein, 135 aa, Homo sapiens
  Payload ID: 15459
  Gene Symbol: SCPEP1
  Gene Name: serine carboxypeptidase 1
  ENSP ID: ENSP00000461678
  MOD_RES (1)..(1): Any amino acid
XTMESSLEFTQSHLGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 77575 - protein, 95 aa, Homo sapiens
  Payload ID: 15459
  Gene Symbol: SCPEP1
  Gene Name: serine carboxypeptidase 1
  ENSP ID: ENSP00000461694
MVASDMMVLLKTFFSCHKEFQTVPFYIFSESYGGKMAAGIGLELYKAIQRGTIKCNFAGVALGDSWISPVDSVLSWGPYLYSMSLLEDKGLAEVS

SEQ ID NO: 77576 - protein, 147 aa, Homo sapiens; identical to SEQ ID NO: 77572
  Payload ID: 15459
  Gene Symbol: SCPEP1
  Gene Name: serine carboxypeptidase 1
  ENSP ID: ENSP00000487541

SEQ ID NO: 77577 - protein, 328 aa, Homo sapiens
  Payload ID: 15460
  Gene Symbol: SDS
  Gene Name: serine dehydratase
  Uniprot ID: P20132
  ENSP ID: ENSP00000257549
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAIEKFVDDEKILVEPACGAALAAVYSHVIQKLQLEGNLRTPLPSLVVIVCGGSNISLAQLRALKEQLGMTNRLPK

SEQ ID NO: 77578 - protein, 235 aa, Homo sapiens
  Payload ID: 15460
  Gene Symbol: SDS
  Gene Name: serine dehydratase
  ENSP ID: ENSP00000449061
MDDRKRAKRKSSYREQQPGPPRGRNALWGAADADRRGLGQERRGFTMLAGLKLLSSSDLPTSASRSAGTTSVSHRAQPFERFEAEELCVNGPVGMMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLI

SEQ ID NO: 77579 - protein, 97 aa, Homo sapiens
  Payload ID: 15460
  Gene Symbol: SDS
  Gene Name: serine dehydratase
  ENSP ID: ENSP00000449833
MMSGEPLHVKTPIRDSMALSKMAGTSVYLKMDSAQPSGSFKIRGIGHFCKRGRPRFHRERAEGDTVGKAGGHRAVSGRRGPAVWSGPGAAGGGLGGR

SEQ ID NO: 77580 - protein, 329 aa, Homo sapiens
  Payload ID: 15461
  Gene Symbol: SDSL
  Gene Name: serine dehydratase-like
  Uniprot ID: Q96GA7
  ENSP ID: ENSP00000341117
MDGPVAEHAKQEPFHVVTPLLESWALSQVAGMPVFLKCENVQPSGSFKIRGIGHFCQEMAKKGCRHLVCSSGGNAGIAAAYAARKLGIPATIVLPESTSLQVVQRLQGEGAEVQLTGKVWDEANLRAQELAKRDGWENVPPFDHPLIWKGHASLVQELKAVLRTPPGALVLAVGGGGLLAGVVAGLLEVGWQHVPIIAMETHGAHCFNAAITAGKLVTLPDITSVAKSLGAKTVAARALECMQVCKIHSEVVEDTEAVSAVQQLLDDERMLVEPACGAALAAIYSGLLRRLQAEGCLPPSLTSVVVIVCGGNNINSRELQALKTHLGQV

SEQ ID NO: 77581 - protein, 329 aa, Homo sapiens; identical to SEQ ID NO: 77580
  Payload ID: 15461
  Gene Symbol: SDSL
  Gene Name: serine dehydratase-like
  Uniprot ID: Q96GA7
  ENSP ID: ENSP00000385790

SEQ ID NO: 77582 - protein, 29 aa, Homo sapiens
  Payload ID: 15461
  Gene Symbol: SDSL
  Gene Name: serine dehydratase-like
  ENSP ID: ENSP00000446867
MDGPVAEHAKQEPFHVVTPLLESWALSQV

SEQ ID NO: 77583 - protein, 172 aa, Homo sapiens
  Payload ID: 15461
  Gene Symbol: SDSL
  Gene Name: serine dehydratase-like
  ENSP ID: ENSP00000448868
MAKKGCRHLVCSSGGNAGIAAAYAARKLGIPATIVLPESTSLQVVQRLQGEGAEVQLTGKVWDEANLRAQELAKRDGWENVPPFDHPLIWKGHASLVQELKAVLRTPPGALVLAVGGGGLLAGVVAGLLEVGWQHVPIIAMETHGAHCFNAAITAGKLVTLPDITSVAKSLG

SEQ ID NO: 77584 - protein, 60 aa, Homo sapiens
  Payload ID: 15461
  Gene Symbol: SDSL
  Gene Name: serine dehydratase-like
  ENSP ID: ENSP00000448950
NAAITAGKLVTLPDITSVAKSLGAKTVAARALECMQVCKIHSEVVEDTEAVSAVQQLLGE

SEQ ID NO: 77585 - protein, 225 aa, Homo sapiens
  Payload ID: 15461
  Gene Symbol: SDSL
  Gene Name: serine dehydratase-like
  ENSP ID: ENSP00000449136
  MOD_RES (1)..(1): Any amino acid
XWPRRDADTWCAPQVWDEANLRAQELAKRDGWENVPPFDHPLIWKGHASLVQELKAVLRTPPGALVLAVGGGGLLAGVVAGLLEVGWQHVPIIAMETHGAHCFNAAITAGKLVTLPDITSVAKSLGAKTVAARALECMQVCKIHSEVVEDTEAVSAVQQLLDDERMLVEPACGAALAAIYSGLLRRLQAEGCLPPSLTSVVVIVCGGNNINSRELQALKTHLGQV

SEQ ID NO: 77586 - protein, 314 aa, Homo sapiens
  Payload ID: 15462
  Gene Symbol: SERHL2
  Gene Name: serine hydrolase-like 2
  Uniprot ID: Q9H4I8
  ENSP ID: ENSP00000331376
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 77587 - protein, 250 aa, Homo sapiens
  Payload ID: 15462
  Gene Symbol: SERHL2
  Gene Name: serine hydrolase-like 2
  Uniprot ID: Q9H4I8
  ENSP ID: ENSP00000336578
MSENAAPDFYYVAMDFGGHGLSSHYSPGVPYYLQTFVSEIRRVVAGGVVGGMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 77588 - protein, 203 aa, Homo sapiens
  Payload ID: 15462
  Gene Symbol: SERHL2
  Gene Name: serine hydrolase-like 2
  ENSP ID: ENSP00000342425
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRQRTALTSSAGSCVRIPSGSCRPMSC

SEQ ID NO: 77589 - protein, 134 aa, Homo sapiens
  Payload ID: 15462
  Gene Symbol: SERHL2
  Gene Name: serine hydrolase-like 2
  Uniprot ID: Q9H4I8
  ENSP ID: ENSP00000385691
MSENAAPGLISELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 77590 - protein, 99 aa, Homo sapiens
  Payload ID: 15462
  Gene Symbol: SERHL2
  Gene Name: serine hydrolase-like 2
  ENSP ID: ENSP00000395860
MDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEA

SEQ ID NO: 77591 - protein, 131 aa, Homo sapiens
  Payload ID: 15462
  Gene Symbol: SERHL2
  Gene Name: serine hydrolase-like 2
  ENSP ID: ENSP00000413512
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFALLSPRWRRGRNVFLYLPRDGG

SEQ ID NO: 77592 - protein, 209 aa, Homo sapiens
  Payload ID: 15462
  Gene Symbol: SERHL2
  Gene Name: serine hydrolase-like 2
  ENSP ID: ENSP00000435091
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRLLKSNSHLSEECGELLLQRGTTKVATGREQH

SEQ ID NO: 77593 - protein, 444 aa, Homo sapiens
  Payload ID: 15463
  Gene Symbol: SHMT1
  Gene Name: serine hydroxymethyltransferase 1 (soluble)
  Uniprot ID: P34896
  ENSP ID: ENSP00000318805
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 77594 - protein, 483 aa, Homo sapiens
  Payload ID: 15463
  Gene Symbol: SHMT1
  Gene Name: serine hydroxymethyltransferase 1 (soluble)
  Uniprot ID: P34896
  ENSP ID: ENSP00000318868
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 77595 - protein, 345 aa, Homo sapiens
  Payload ID: 15463
  Gene Symbol: SHMT1
  Gene Name: serine hydroxymethyltransferase 1 (soluble)
  Uniprot ID: P34896
  ENSP ID: ENSP00000345881
MGLDLPDGGHLTHGFMTDKKKISATSIFFESMPYKVNPDTGYINYDQLEENARLFHPKLIIAGTSCYSRNLEYARLRKIADENGAYLMADMAHISGLVAAGVVPSPFEHCHVVTTTTHKTLRGCRAGMIFYRKGVKSVDPKTGKEILYNLESLINSAVFPGLQGGPHNHAIAGVAVALKQAMTLEFKVYQHQVVANCRALSEALTELGYKIVTGGSDNHLILVDLRSKGTDGGRAEKVLEACSIACNKNTCPGDRSALRPSGLRLGTPALTSRGLLEKDFQKVAHFIHRGIELTLQIQSDTGVRATLKEFKERLAGDKYQAAVQALREEVESFASLFPLPGLPDF

SEQ ID NO: 77596 - protein, 1 aa, Homo sapiens
  Payload ID: 15463
  Gene Symbol: SHMT1
  Gene Name: serine hydroxymethyltransferase 1 (soluble)
  ENSP ID: ENSP00000462041
M

SEQ ID NO: 77597 - protein, 128 aa, Homo sapiens
  Payload ID: 15463
  Gene Symbol: SHMT1
  Gene Name: serine hydroxymethyltransferase 1 (soluble)
  ENSP ID: ENSP00000462043
MTMPVNGAHKDADLWSSHDKMLAQPLKDSDVEVYNIIKKESNRQRVGLELIASENFASRAVLEALGSCLNNKYSEGYPGQRLPCKLCCVHCPGGTPWAHHGPGPSGWGPPDPWVHDRQEENLCHVHLL

SEQ ID NO: 77598 - protein, 167 aa, Homo sapiens
  Payload ID: 15463
  Gene Symbol: SHMT1
  Gene Name: serine hydroxymethyltransferase 1 (soluble)
  ENSP ID: ENSP00000462227
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFF

SEQ ID NO: 77599 - protein, 125 aa, Homo sapiens [sequence omitted]

SEQ ID NO: 77600 - protein, 504 aa, Homo sapiens
  Payload ID: 15464
  Gene Symbol: SHMT2
  Gene Name: serine hydroxymethyltransferase 2 (mitochondrial)
  Uniprot ID: P34897
  ENSP ID: ENSP00000333667
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 77601 - protein, 483 aa, Homo sapiens
  Payload ID: 15464
  Gene Symbol: SHMT2
  Gene Name: serine hydroxymethyltransferase 2 (mitochondrial)
  Uniprot ID: P34897
  ENSP ID: ENSP00000406881
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 77602 - protein, 483 aa, Homo sapiens; identical to SEQ ID NO: 77601
  Payload ID: 15464
  Gene Symbol: SHMT2
  Gene Name: serine hydroxymethyltransferase 2 (mitochondrial)
  Uniprot ID: P34897
  ENSP ID: ENSP00000413770

SEQ ID NO: 77603 - protein, 142 aa, Homo sapiens
  Payload ID: 15464
  Gene Symbol: SHMT2
  Gene Name: serine hydroxymethyltransferase 2 (mitochondrial)
  ENSP ID: ENSP00000450452
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMG

SEQ ID NO: 77604 - protein, 264 aa, Homo sapiens
  Payload ID: 15464
  Gene Symbol: SHMT2
  Gene Name: serine hydroxymethyltransferase 2 (mitochondrial)
  ENSP ID: ENSP00000450490
  MOD_RES (1)..(1): Any amino acid
XGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTGE

SEQ ID NO: 77605 - protein, 52 aa, Homo sapiens
  Payload ID: 15464
  Gene Symbol: SHMT2
  Gene Name: serine hydroxymethyltransferase 2 (mitochondrial)
  ENSP ID: ENSP00000450594
MGLDLPDGGHLTHGYMSDVKRISATSIFFESMPYKLNGFSCLCVCPAQNWPH

SEQ ID NO: 77606 - protein, 171 aa, Homo sapiens
  Payload ID: 15464
  Gene Symbol: SHMT2
  Gene Name: serine hydroxymethyltransferase 2 (mitochondrial)
  ENSP ID: ENSP00000450610
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGQ

SEQ ID NO: 77607 - protein, 160 aa, Homo sapiens
  Payload ID: 15464
  Gene Symbol: SHMT2
  Gene Name: serine hydroxymethyltransferase 2 (mitochondrial)
  ENSP ID: ENSP00000450893
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVK

SEQ ID NO: 77608 - protein, 65 aa, Homo sapiens
  Payload ID: 15464
  Gene Symbol: SHMT2
  Gene Name: serine hydroxymethyltransferase 2 (mitochondrial)
  ENSP ID: ENSP00000450927
MAIRAQHSNAAQTQTGEANRGWTGQESLSDSDPEMWELLQREKDRQCRGLELIASEILWGSRGGG

SEQ ID NO: 77609 - protein, 234 aa, Homo sapiens
  Payload ID: 15464
  Gene Symbol: SHMT2
  Gene Name: serine hydroxymethyltransferase 2 (mitochondrial)
  ENSP ID: ENSP00000450930
MGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGAR

SEQ ID NO: 77610 - protein, 86 aa, Homo sapiens
  Payload ID: 15464
  Gene Symbol: SHMT2
  Gene Name: serine hydroxymethyltransferase 2 (mitochondrial)
  ENSP ID: ENSP00000451169
MLYFSLFWAARPLQRCGQLVRMAIRAQHSNAAQTQTGEANRGWTGQESLSDSDPEMWELLQREKDRQCRGLELIASEILWGSRGGG

SEQ ID NO: 77611 - protein, 192 aa, Homo sapiens
  Payload ID: 15464
  Gene Symbol: SHMT2
  Gene Name: serine hydroxymethyltransferase 2 (mitochondrial)
  ENSP ID: ENSP00000451371
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNGFSCLCVCPAQNWPH

SEQ ID NO: 77612 - protein, 147 aa, Homo sapiens
  Payload ID: 15464
  Gene Symbol: SHMT2
  Gene Name: serine hydroxymethyltransferase 2 (mitochondrial)
  ENSP ID: ENSP00000451495
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPD

SEQ ID NO: 77613 - protein, 86 aa, Homo sapiens; identical to SEQ ID NO: 77610
  Payload ID: 15464
  Gene Symbol: SHMT2
  Gene Name: serine hydroxymethyltransferase 2 (mitochondrial)
  ENSP ID: ENSP00000451630

SEQ ID NO: 77614 - protein, 65 aa, Homo sapiens; identical to SEQ ID NO: 77608
  Payload ID: 15464
  Gene Symbol: SHMT2
  Gene Name: serine hydroxymethyltransferase 2 (mitochondrial)
  ENSP ID: ENSP00000451872

SEQ ID NO: 77615 - protein, 149 aa, Homo sapiens
  Payload ID: 15464
  Gene Symbol: SHMT2
  Gene Name: serine hydroxymethyltransferase 2 (mitochondrial)
  ENSP ID: ENSP00000451968
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGG

SEQ ID NO: 77616 - protein, 237 aa, Homo sapiens
  Payload ID: 15464
  Gene Symbol: SHMT2
  Gene Name: serine hydroxymethyltransferase 2 (mitochondrial)
  ENSP ID: ENSP00000452035
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNVCDEVKAHLLADMAHISGLVAAKVIPSPFKHADIVTTTT

SEQ ID NO: 77617 - protein, 159 aa, Homo sapiens
  Payload ID: 15464
  Gene Symbol: SHMT2
  Gene Name: serine hydroxymethyltransferase 2 (mitochondrial)
  ENSP ID: ENSP00000452045
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDV

SEQ ID NO: 77618 - protein, 147 aa, Homo sapiens; identical to SEQ ID NO: 77612
  Payload ID: 15464
  Gene Symbol: SHMT2
  Gene Name: serine hydroxymethyltransferase 2 (mitochondrial)
  ENSP ID: ENSP00000452161

SEQ ID NO: 77619 - protein, 192 aa, Homo sapiens; identical to SEQ ID NO: 77611
  Payload ID: 15464
  Gene Symbol: SHMT2
  Gene Name: serine hydroxymethyltransferase 2 (mitochondrial)
  ENSP ID: ENSP00000452163

SEQ ID NO: 77620 - protein, 494 aa, Homo sapiens
  Payload ID: 15464
  Gene Symbol: SHMT2
  Gene Name: serine hydroxymethyltransferase 2 (mitochondrial)
  Uniprot ID: P34897
  ENSP ID: ENSP00000452315
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 77621 - protein, 65 aa, Homo sapiens; identical to SEQ ID NO: 77608
  Payload ID: 15464
  Gene Symbol: SHMT2
  Gene Name: serine hydroxymethyltransferase 2 (mitochondrial)
  ENSP ID: ENSP00000452339

SEQ ID NO: 77622 - protein, 215 aa, Homo sapiens
  Payload ID: 15464
  Gene Symbol: SHMT2
  Gene Name: serine hydroxymethyltransferase 2 (mitochondrial)
  ENSP ID: ENSP00000452404
MAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYAR

SEQ ID NO: 77623 - protein, 483 aa, Homo sapiens; identical to SEQ ID NO: 77601
  Payload ID: 15464
  Gene Symbol: SHMT2
  Gene Name: serine hydroxymethyltransferase 2 (mitochondrial)
  Uniprot ID: P34897
  ENSP ID: ENSP00000452419

SEQ ID NO: 77624 - protein, 453 aa, Homo sapiens
  Payload ID: 15465
  Gene Symbol: SERINC1
  Gene Name: serine incorporator 1
  Uniprot ID: Q9NRX5
  ENSP ID: ENSP00000342962
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMFYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRSGLLQSSVITVYTMYLTWSAMTNEPETNCNPSLLSIIGYNTTSTVPKEGQSVQWWHAQGIIGLILFLLCVFYSSIRTSNNSQVNKLTLTSDESTLIEDGGARSDGSLEDGDDVHRAVDNERDGVTYSYSFFHFMLFLASLYIMMTLTNWYRYEPSREMKSQWTAVWVKISSSWIGIVLYVWTLVAPLVLTNRDFD

SEQ ID NO: 77625 - protein, 455 aa, Homo sapiens
  Payload ID: 15466
  Gene Symbol: SERINC2
  Gene Name: serine incorporator 2
  Uniprot ID: Q96SA4
  ENSP ID: ENSP00000362813
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 77626 - protein, 464 aa, Homo sapiens
  Payload ID: 15466
  Gene Symbol: SERINC2
  Gene Name: serine incorporator 2
  Uniprot ID: Q96SA4
  ENSP ID: ENSP00000362814
MDGRMMRSMRLREEESPGPSHTASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 77627 - protein, 459 aa, Homo sapiens
  Payload ID: 15466
  Gene Symbol: SERINC2
  Gene Name: serine incorporator 2
  Uniprot ID: Q96SA4
  ENSP ID: ENSP00000439048
MGAEGAPDFLSCPRVRRASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 77628 - protein, 459 aa, Homo sapiens
  Payload ID: 15466
  Gene Symbol: SERINC2
  Gene Name: serine incorporator 2
  Uniprot ID: Q96SA4
  ENSP ID: ENSP00000444307
MRSMRLREEESPGPSHTASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 77629 - protein, 473 aa, Homo sapiens
  Payload ID: 15467
  Gene Symbol: SERINC3
  Gene Name: serine incorporator 3
  Uniprot ID: Q13530
  ENSP ID: ENSP00000255175
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 77630 - protein, 473 aa, Homo sapiens; identical to SEQ ID NO: 77629
  Payload ID: 15467
  Gene Symbol: SERINC3
  Gene Name: serine incorporator 3
  Uniprot ID: Q13530
  ENSP ID: ENSP00000340243

SEQ ID NO: 77631 - protein, 212 aa, Homo sapiens
  Payload ID: 15467
  Gene Symbol: SERINC3
  Gene Name: serine incorporator 3
  ENSP ID: ENSP00000414197
EHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 77632 - protein, 426 aa, Homo sapiens
  Payload ID: 15468
  Gene Symbol: SERINC4
  Gene Name: serine incorporator 4
  ENSP ID: ENSP00000299969
MVGAKAGPSPGTSLGLAQQHSGGSSVLVKSPFCQVCCCGPAPCASCCHSRWPSLTASTCSRLFYILLHVGASAICCLLLSRTVVERVWGKTHRIQMPSGLCAHLFGLSDCPVLSGSGAVYRVCAGTATFHLLQAVLLVHLHSPTSPRAQLHNSFWLLKLLFLLGLCAIAFCIPDEHLFPAWHYIGICGGFAFILLQLVLITAFAHSWNKNWQTGAAQDCSWFLAVLLATLGFYSMAGVGAVLLFHYYTHPAGCLLNKMLLSLHLCFCGLISFLSIAPCIRLTMRPPTWLRYLDPCGLSRFTAMSFRSPHCVSAALKQWRQTKGKGVGLRGQLTKKPLQLLQSKSSIFPTTILPSTSSSSLPHSMSWLPLPTGSAMREQNWKRPSSRVAGPPSGSRLPHAGPAYSSIWGCYWHHSVGPPPRNPSPLS

SEQ ID NO: 77633 - protein, 518 aa, Homo sapiens
  Payload ID: 15468
  Gene Symbol: SERINC4
  Gene Name: serine incorporator 4
  Uniprot ID: A6NH21
  ENSP ID: ENSP00000319796
MVGAKAGPSPGTSLGLAQQHSGGSSVLVKSPFCQVCCCGPAPCASCCHSRWPSLTASTCSRLFYILLHVGASAICCLLLSRTVVERVWGKTHRIQMPSGLCAHLFGLSDCPVLSGSGAVYRVCAGTATFHLLQAVLLVHLHSPTSPRAQLHNSFWLLKLLFLLGLCAIAFCIPDEHLFPAWHYIGICGGFAFILLQLVLITAFAHSWNKNWQTGAAQDCSWFLAVLLATLGFYSMAGVGAVLLFHYYTHPAGCLLNKMLLSLHLCFCGLISFLSIAPCIRLKQPRSGLLQASVISCYIMYLTFSALSSRPPERVILQGQNHTLCLPGLSKMEPQTPDISLAMLSASIMYACVLFACNEASYLAEVFGPLWIVKVYSYEFQKPSLCFCCPETVEADKGQRGGAARPADQETPPAPPVQVQHLSYNYSAFHFVFFLASLYVMVTLTNWFSYEGAELEKTFIKGSWATFWVKVASCWACVLLYLGLLLAPLCWPPTQKPQPLILRRRRHRIISPDNKYPPV

SEQ ID NO: 77634 - protein, 236 aa, Homo sapiens
  Payload ID: 15468
  Gene Symbol: SERINC4
  Gene Name: serine incorporator 4
  ENSP ID: ENSP00000399074
  MOD_RES (1)..(1): Any amino acid
XMPSGLCAHLFGLSDCPVLSGSGAVYRVCAGTATFHLLQAVLLVHLHSPTSPRAQLHNSFWLLKLLFLLGLCAIAFCIPDEHLFPAWHYIGICGGFAFILLQLVLITAFAHSWNKNWQTGAAQDCSWFLAVLLATLGFYSMAGVGAVLLFHYYTHPAGCLLNKMLLSLHLCFCGLISFLSIAPCIRLSGATPLWPPTSFCHQLLYHVSDFLCTVQPSSRESNPSRTESHPVPAWPE

SEQ ID NO: 77635 - protein, 96 aa, Homo sapiens
  Payload ID: 15468
  Gene Symbol: SERINC4
  Gene Name: serine incorporator 4
  ENSP ID: ENSP00000402868
MVGAKAGPSPGTSLGLAQQHSGGSSVLVKSPFCQQVSTSLPCICSTPRCAAVGLLLVPAAATLGGPLSPHPLAAACSTSSSMWGPQQSAASCCQGQ

SEQ ID NO: 77636 - protein, 89 aa, Homo sapiens
  Payload ID: 15468
  Gene Symbol: SERINC4
  Gene Name: serine incorporator 4
  ENSP ID: ENSP00000408781
  MOD_RES (1)..(1): Any amino acid
XSGLCAHLFGLSDCPVLSGSGAVYRVCAGTATFHLLQAVLLVHLHSPTSPRAQLHNSMALHWHLWRLCIHPTAVGAYYSFCPFLEQELQ

SEQ ID NO: 77637 - protein, 417 aa, Homo sapiens
  Payload ID: 15469
  Gene Symbol: SERINC5
  Gene Name: serine incorporator 5
  ENSP ID: ENSP00000420863
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFKSGPF

SEQ ID NO: 77638 - protein, 417 aa, Homo sapiens
  Payload ID: 15469
  Gene Symbol: SERINC5
  Gene Name: serine incorporator 5
  Uniprot ID: Q86VE9
  ENSP ID: ENSP00000421665
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFKNYQC

SEQ ID NO: 77639 - protein, 420 aa, Homo sapiens
  Payload ID: 15469
  Gene Symbol: SERINC5
  Gene Name: serine incorporator 5
  Uniprot ID: Q86VE9
  ENSP ID: ENSP00000426134
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFKSAFHLLP

SEQ ID NO: 77640 - protein, 461 aa, Homo sapiens
  Payload ID: 15469
  Gene Symbol: SERINC5
  Gene Name: serine incorporator 5
  Uniprot ID: Q86VE9
  ENSP ID: ENSP00000426237
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFNYESANIESFFSGSWSIFWVKMASCWICVLLYLCTLVAPLCCPTREFSV

SEQ ID NO: 77641 - protein, 456 aa, Homo sapiens
  Payload ID: 15469
  Gene Symbol: SERINC5
  Gene Name: serine incorporator 5
  ENSP ID: ENSP00000488864
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFKWSPTLLPRLEYSGMILAHCNLHLPDVKRFSCLSLPSSWGYRHVPP

SEQ ID NO: 77642 - protein, 473 aa, Homo sapiens
  Payload ID: 15470
  Gene Symbol: SPTLC1
  Gene Name: serine palmitoyltransferase, long chain base subunit 1
  Uniprot ID: O15269
  ENSP ID: ENSP00000262554
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 77643 - protein, 143 aa, Homo sapiens
  Payload ID: 15470
  Gene Symbol: SPTLC1
  Gene Name: serine palmitoyltransferase, long chain base subunit 1
  Uniprot ID: O15269
  ENSP ID: ENSP00000337635
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFE

SEQ ID NO: 77644 - protein, 562 aa, Homo sapiens
  Payload ID: 15471
  Gene Symbol: SPTLC2
  Gene Name: serine palmitoyltransferase, long chain base subunit 2
  Uniprot ID: O15270
  ENSP ID: ENSP00000216484
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCLILSDELNHASLVLGARLSGATIRIFKHNNMQSLEKLLKDAIVYGQPRTRRPWKKILILVEGIYSMEGSIVRLPEVIALKKKYKAYLYLDEAHSIGALGPTGRGVVEYFGLDPEDVDVMMGTFTKSFGASGGYIGGKKELIDYLRTHSHSAVYATSLSPPVVEQIITSMKCIMGQDGTSLGKECVQQLAENTRYFRRRLKEMGFIIYGNEDSPVVPLMLYMPAKIGAFGREMLKRNIGVVVVGFPATPIIESRARFCLSAAHTKEILDTALKEIDEVGDLLQLKYSRHRLVPLLDRPFDETTYEETED

SEQ ID NO: 77645 - protein, 40 aa, Homo sapiens
  Payload ID: 15471
  Gene Symbol: SPTLC2
  Gene Name: serine palmitoyltransferase, long chain base subunit 2
  ENSP ID: ENSP00000451029
HSAVYATSLSPPVVEQIITSMKCIMGQDGTSLGLFCFLSP

SEQ ID NO: 77646 - protein, 407 aa, Homo sapiens
  Payload ID: 15471
  Gene Symbol: SPTLC2
  Gene Name: serine palmitoyltransferase, long chain base subunit 2
  ENSP ID: ENSP00000452189
  MOD_RES (1)..(1): Any amino acid
XETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCLILSDELNHASLVLGARLSGATIRIFKHNNMQSLEKLLKDAIVYGQPRTRRPWKKILILVEGIYSMEGSIVRLPEVIALKKKYKAYLYLDEAHSIGALGPTGRGVVEYFGLDPEDVDVMMGTFTKSFGASGGYIGGKKELIDYLRTHSHSAVYATSLSPPVVEQIITSMKCIMGQDGTSLGNGITIHEVVQTRNTYHRFSPLSPVFSHQCLWIMLP

SEQ ID NO: 77647 - protein, 552 aa, Homo sapiens
  Payload ID: 15472
  Gene Symbol: SPTLC3
  Gene Name: serine palmitoyltransferase, long chain base subunit 3
  Uniprot ID: Q9NUV7
  ENSP ID: ENSP00000381968
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFDLMERVSDDYNWTFRFTGRVIKDVINMGSYNFLGLAAKYDESMRTIKDVLEVYGTGVASTRHEMGTLDKHKELEDLVAKFLNVEAAMVFGMGFATNSMNIPALVGKGCLILSDELNHTSLVLGARLSGATIRIFKHNNTQSLEKLLRDAVIYGQPRTRRAWKKILILVEGVYSMEGSIVHLPQIIALKKKYKAYLYIDEAHSIGAVGPTGRGVTEFFGLDPHEVDVLMGTFTKSFGASGGYIAGRKDLVDYLRVHSHSAVYASSMSPPIAEQIIRSLKLIMGLDGTTQGLQRVQQLAKNTRYFRQRLQEMGFIIYGNENASVVPLLLYMPGKVAAFARHMLEKKIGVVVVGFPATPLAEARARFCVSAAHTREMLDTVLEALDEMGDLLQLKYSRHKKSARPELYDETSFELED

SEQ ID NO: 77648 - protein, 139 aa, Homo sapiens
  Payload ID: 15472
  Gene Symbol: SPTLC3
  Gene Name: serine palmitoyltransferase, long chain base subunit 3
  ENSP ID: ENSP00000389749
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFD

SEQ ID NO: 77649 - protein, 215 aa, Homo sapiens
  Payload ID: 15472
  Gene Symbol: SPTLC3
  Gene Name: serine palmitoyltransferase, long chain base subunit 3
  ENSP ID: ENSP00000409125
NCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFDLMERVSDDYNWTFRFTGRVIKDVINMGSYNFLGLAAKYDESMRTIKDVLEVYGTGVASTRHEMGEFTSSWQNALCVGGVLQADSVPQGPPWSWKMGRHSSLLE

SEQ ID NO: 77650 - protein, 121 aa, Homo sapiens
  Payload ID: 15472
  Gene Symbol: SPTLC3
  Gene Name: serine palmitoyltransferase, long chain base subunit 3
  ENSP ID: ENSP00000409760
  MOD_RES (1)..(1): Any amino acid
XSPPIAEQIIRSLKLIMGLDGTTQGLQRVQQLAKNTRYFRQRLQEMGFIIYGNENASVVPLLLYMPGKVAAFARHMLEKKIGVVVVGFPATPLAEARARFCVSAAHTREMLDTVICCVMKI

SEQ ID NO: 77651 - protein, 71 aa, Homo sapiens
  Payload ID: 15473
  Gene Symbol: SPTSSA
  Gene Name: serine palmitoyltransferase, small subunit A
  Uniprot ID: Q969W0
  ENSP ID: ENSP00000298130
MAGMALARAWKQMSWFYYQYLLVTALYMLEPWERTVFNSMLVSIVGMALYTGYVFMPQHIMAILHYFEIVQ

SEQ ID NO: 77652 - protein, 76 aa, Homo sapiens
  Payload ID: 15474
  Gene Symbol: SPTSSB
  Gene Name: serine palmitoyltransferase, small subunit B
  Uniprot ID: Q8NFR3
  ENSP ID: ENSP00000352097
MDLRRVKEYFSWLYYQYQIISCCAVLEPWERSMFNTILLTIIAMVVYTAYVFIPIHIRLAWEFFSKICGYHSTISN

SEQ ID NO: 77653 - protein, 76 aa, Homo sapiens; identical to SEQ ID NO: 77652
  Payload ID: 15474
  Gene Symbol: SPTSSB
  Gene Name: serine palmitoyltransferase, small subunit B
  Uniprot ID: Q8NFR3
  ENSP ID: ENSP00000420115

SEQ ID NO: 77654 - protein, 76 aa, Homo sapiens; identical to SEQ ID NO: 77652
  Payload ID: 15474
  Gene Symbol: SPTSSB
  Gene Name: serine palmitoyltransferase, small subunit B
  Uniprot ID: Q8NFR3
  ENSP ID: ENSP00000480827

SEQ ID NO: 77655 - protein, 230 aa, Homo sapiens
  Payload ID: 15474
  Gene Symbol: SPTSSB
  Gene Name: serine palmitoyltransferase, small subunit B
  ENSP ID: ENSP00000483928
MDVGFQGRCSRWSRALRGRYSSAERKRRARQPREPREQAPRVSAPPGRLPAFFPQFALLPQSGPRLILCTCEWAHTSSPGTILSSISLGESTFLTINLLATAGKVAGCEWGGEGRFTRSEAPKLAASAKRLCFLRFLTNKWGGMLAWPPAAPARALGSLSSLMPSFRRSPAALTPGLLRPLAKVCSPMDAGRGLSLSALTQLRLKPQSSHLLPPVYPPAPLPPPKDVPLQ

SEQ ID NO: 77656 - protein, 79 aa, Homo sapiens
  Payload ID: 15475
  Gene Symbol: SPINK1
  Gene Name: serine peptidase inhibitor, Kazal type 1
  Uniprot ID: P00995
  ENSP ID: ENSP00000296695
MKVTGIFLLSALALLSLSGNTGADSLGREAKCYNELNGCTKIYDPVCGTDGNTYPNECVLCFENRKRQTSILIQKSGPC

SEQ ID NO: 77657 - protein, 65 aa, Homo sapiens
  Payload ID: 15475
  Gene Symbol: SPINK1
  Gene Name: serine peptidase inhibitor, Kazal type 1
  ENSP ID: ENSP00000427376
MKVTGIFLLSALALLSLSGNTGADSLGREAKCYNELNGCTKIYDPVCGTDGNTYPNECVLCFENR

SEQ ID NO: 77658 - protein, 94 aa, Homo sapiens
  Payload ID: 15476
  Gene Symbol: SPINK13
  Gene Name: serine peptidase inhibitor, Kazal type 13 (putative)
  Uniprot ID: Q1W4C9
  ENSP ID: ENSP00000381468
MAAFPHKIIFFLVCSTLTHVAFSGIFNKRDFTRWPKPRCKMYIPLDPDYNADCPNVTAPVCASNGHTFQNECFFCVEQREFHYRIKFEKYGKCD

SEQ ID NO: 77659 - protein, 94 aa, Homo sapiens; identical to SEQ ID NO: 77658
  Payload ID: 15476
  Gene Symbol: SPINK13
  Gene Name: serine peptidase inhibitor, Kazal type 13 (putative)
  Uniprot ID: Q1W4C9
  ENSP ID: ENSP00000421048

SEQ ID NO: 77660 - protein, 54 aa, Homo sapiens
  Payload ID: 15476
  Gene Symbol: SPINK13
  Gene Name: serine peptidase inhibitor, Kazal type 13 (putative)
  Uniprot ID: Q1W4C9
  ENSP ID: ENSP00000426279
MYIPLDPDYNADCPNVTAPVCASNGHTFQNECFFCVEQREFHYRIKFEKYGKCD

SEQ ID NO: 77661 - protein, 97 aa, Homo sapiens
  Payload ID: 15477
  Gene Symbol: SPINK14
  Gene Name: serine peptidase inhibitor, Kazal type 14 (putative)
  Uniprot ID: Q6IE38
  ENSP ID: ENSP00000349459
MAKSFPVFSLLSFILIHLVLSSVSGPRHWWPPRGIIKVKCPYEKVNLSWYNGTVNPCPGLYQPICGTNFITYDNPCILCVESLKSHGRIRFYHDGKC

SEQ ID NO: 77662 - protein, 47 aa, Homo sapiens
  Payload ID: 15477
  Gene Symbol: SPINK14
  Gene Name: serine peptidase inhibitor, Kazal type 14 (putative)
  ENSP ID: ENSP00000457038
MAKSFPVFSLLSFILIHLVLSSVSGPRHWWPPRGIIKEISWKNQVLP

SEQ ID NO: 77663 - protein, 84 aa, Homo sapiens
  Payload ID: 15478
  Gene Symbol: SPINK2
  Gene Name: serine peptidase inhibitor, Kazal type 2 (acrosin-trypsin inhibitor)
  Uniprot ID: P20155
  ENSP ID: ENSP00000248701
MALSVLRLALLLLAVTFAASLIPQFGLFSKYRTPNCSQYRLPGCPRHFNPVCGSDMSTYANECTLCMKIREGGHNIKIIRNGPC

SEQ ID NO: 77664 - protein, 119 aa, Homo sapiens
  Payload ID: 15478
  Gene Symbol: SPINK2
  Gene Name: serine peptidase inhibitor, Kazal type 2 (acrosin-trypsin inhibitor)
  ENSP ID: ENSP00000423858
MALSVLRLALLLLAVTFAGSARSGPGERGPPEKSGFGSQTGGGPCPAPGGLGDASLIPQFGLFSKYRTPNCSQYRLPGCPRHFNPVCGSDMSTYANECTLCMKIREGGHNIKIIRNGPC

SEQ ID NO: 77665 - protein, 134 aa, Homo sapiens
  Payload ID: 15478
  Gene Symbol: SPINK2
  Gene Name: serine peptidase inhibitor, Kazal type 2 (acrosin-trypsin inhibitor)
  ENSP ID: ENSP00000425961
MALSVLRLALLLLAVTFAGSARSGPGERGPPEKSGFGSQTGGGPCPAPGGLGDGTRAPVTGGSPEDLPASLIPQFGLFSKYRTPNCSQYRLPGCPRHFNPVCGSDMSTYANECTLCMKIREGGHNIKIIRNGPC

SEQ ID NO: 77666 - protein, 134 aa, Homo sapiens
  Payload ID: 15478
  Gene Symbol: SPINK2
  Gene Name: serine peptidase inhibitor, Kazal type 2 (acrosin-trypsin inhibitor)
  ENSP ID: ENSP00000477722
MALSVLRLALLLLAVTFAGSARSGPGERGPPEKSGFGSQTGGGPCPAPGGLGDGTRAPVTGGSPEDLPGKVVIILKSFEMDPADGAVYRKEDGETTFTGRLDKLHFPFFSFPVFLYMRFVNTHFLRAGMEDSHV

SEQ ID NO: 77667 - protein, 88 aa, Homo sapiens [sequence omitted]

SEQ ID NO: 77668 - protein, 103 aa, Homo sapiens [sequence omitted]

SEQ ID NO: 77669 - protein, 86 aa, Homo sapiens
  Payload ID: 15479
  Gene Symbol: SPINK4
  Gene Name: serine peptidase inhibitor, Kazal type 4
  Uniprot ID: O60575
  ENSP ID: ENSP00000369045
MAVRQWVIALALAALLVVDREVPVAAGKLPFSRMPICEHMVESPTCSQMSNLVCGTDGLTYTNECQLCLARIKTKQDIQIMKDGKC

SEQ ID NO: 77670 - protein, 109 aa, Homo sapiens
  Payload ID: 15479
  Gene Symbol: SPINK4
  Gene Name: serine peptidase inhibitor, Kazal type 4
  ENSP ID: ENSP00000369048
MILGIGSSPHLLWTLEGTHIWSLLGDASHTDRLPEAGAGKLLSEVPVAAGKLPFSRMPICEHMVESPTCSQMSNLVCGTDGLTYTNECQLCLARIKTKQDIQIMKDGKC

SEQ ID NO: 77671 - protein, 1064 aa, Homo sapiens
  Payload ID: 15480
  Gene Symbol: SPINK5
  Gene Name: serine peptidase inhibitor, Kazal type 5
  Uniprot ID: Q9NQ38
  ENSP ID: ENSP00000256084
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 77672 - protein, 1094 aa, Homo sapiens
  Payload ID: 15480
  Gene Symbol: SPINK5
  Gene Name: serine peptidase inhibitor, Kazal type 5
  Uniprot ID: Q9NQ38
  ENSP ID: ENSP00000352936
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDQCRQVQNEAEDAKFRQPGRSLASVARMSTDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 77673 - protein, 916 aa, Homo sapiens
  Payload ID: 15480
  Gene Symbol: SPINK5
  Gene Name: serine peptidase inhibitor, Kazal type 5
  Uniprot ID: Q9NQ38
  ENSP ID: ENSP00000381472
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKVIY

SEQ ID NO: 77674 - protein, 869 aa, Homo sapiens
  Payload ID: 15480
  Gene Symbol: SPINK5
  Gene Name: serine peptidase inhibitor, Kazal type 5
  ENSP ID: ENSP00000421519
MKIATVSVLLPLALCLIQDAASKNEDQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSI

SEQ ID NO: 77675 - protein, 201 aa, Homo sapiens
  Payload ID: 15480
  Gene Symbol: SPINK5
  Gene Name: serine peptidase inhibitor, Kazal type 5
  ENSP ID: ENSP00000427943
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQFCEPVMVGEGEGRKDLIHVTLVFFQEIGSKLMARTVLCLSSGT

SEQ ID NO: 77676 - protein, 68 aa, Homo sapiens
  Payload ID: 15480
  Gene Symbol: SPINK5
  Gene Name: serine peptidase inhibitor, Kazal type 5
  ENSP ID: ENSP00000430264
MKIATVSVLLPLALCLIQDAASKNEDQDKKFFQSLDGIMFINKCATCKMILEKEAKSQKRARHLARAP

SEQ ID NO: 77677 - protein, 80 aa, Homo sapiens
  Payload ID: 15481
  Gene Symbol: SPINK6
  Gene Name: serine peptidase inhibitor, Kazal type 6
  Uniprot ID: Q6UWN8
  ENSP ID: ENSP00000324870
MKLSGMFLLLSLALFCFLTGVFSQGGQVDCGEFQDPKVYCTRESNPHCGSDGQTYGNKCAFCKAIVKSGGKISLKHPGKC

SEQ ID NO: 77678 - protein, 41 aa, Homo sapiens
  Payload ID: 15481
  Gene Symbol: SPINK6
  Gene Name: serine peptidase inhibitor, Kazal type 6
  ENSP ID: ENSP00000421119
MKLSGMFLLLSLALFCFLTGVFSQGGQVDCGEFQDPKVYCT

SEQ ID NO: 77679 - protein, 80 aa, Homo sapiens; identical to SEQ ID NO: 77677
  Payload ID: 15481
  Gene Symbol: SPINK6
  Gene Name: serine peptidase inhibitor, Kazal type 6
  Uniprot ID: Q6UWN8
  ENSP ID: ENSP00000481309

SEQ ID NO: 77680 - protein, 85 aa, Homo sapiens
  Payload ID: 15482
  Gene Symbol: SPINK7
  Gene Name: serine peptidase inhibitor, Kazal type 7 (putative)
  Uniprot ID: P58062
  ENSP ID: ENSP00000274565
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 77681 - protein, 59 aa, Homo sapiens
  Payload ID: 15482
  Gene Symbol: SPINK7
  Gene Name: serine peptidase inhibitor, Kazal type 7 (putative)
  ENSP ID: ENSP00000427887
MTQVDCSIYKKYPVVAIPCPITYLPVCGSDYITYGNECHLCTESLKSNGRVQFLHDGSC

SEQ ID NO: 77682 - protein, 97 aa, Homo sapiens
  Payload ID: 15483
  Gene Symbol: SPINK8
  Gene Name: serine peptidase inhibitor, Kazal type 8 (putative)
  Uniprot ID: P0C7L1
  ENSP ID: ENSP00000407497
MKGICSDAILVLATSMWMAFAIDFPLPMASERGQLDKTIVECLKNVNKCWFLSYIKPSEPICGSDQVTYSSDCHLCSKILFEGLNITKLYDGQCENS

SEQ ID NO: 77683 - protein, 86 aa, Homo sapiens
  Payload ID: 15484
  Gene Symbol: SPINK9
  Gene Name: serine peptidase inhibitor, Kazal type 9
  Uniprot ID: Q5DT21
  ENSP ID: ENSP00000367139
MRATAIVLLLALTLATMFSIECAKQTKQMVDCSHYKKLPPGQQRFCHHMYDPICGSDGKTYKNDCFFCSKVKKTDGTLKFVHFGKC

SEQ ID NO: 77684 - protein, 107 aa, Homo sapiens
  Payload ID: 15484
  Gene Symbol: SPINK9
  Gene Name: serine peptidase inhibitor, Kazal type 9
  ENSP ID: ENSP00000427240
MVFMNPSHHCFHYKTPPSSSGEHNEPRRLMGLTQPEHLQGIECAKQTKQMVDCSHYKKLPPGQQRFCHHMYDPICGSDGKTYKNDCFFCSKVKKTDGTLKFVHFGKC

SEQ ID NO: 77685 - protein, 529 aa, Homo sapiens
  Payload ID: 15485
  Gene Symbol: SPINT1
  Gene Name: serine peptidase inhibitor, Kunitz type 1
  Uniprot ID: O43278
  ENSP ID: ENSP00000342098
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 77686 - protein, 294 aa, Homo sapiens
  Payload ID: 15485
  Gene Symbol: SPINT1
  Gene Name: serine peptidase inhibitor, Kunitz type 1
  ENSP ID: ENSP00000454315
ELWGLKEGTYLFQLTVTSSDHPEDTANVTVTVLSTKQTEDYCLASNKVGRCRGSFPRWYYDPTEQICKSFVYGGCLGNKNNYLREEECILACRGVQVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTR

SEQ ID NO: 77687 - protein, 204 aa, Homo sapiens
  Payload ID: 15485
  Gene Symbol: SPINT1
  Gene Name: serine peptidase inhibitor, Kunitz type 1
  ENSP ID: ENSP00000455038
  MOD_RES (1)..(1): Any amino acid
XLGNKNNYLREEECILACRGVQGGPLRGSSGAQATFPQGPSMERRHPDTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRP

SEQ ID NO: 77688 - protein, 240 aa, Homo sapiens
  Payload ID: 15485
  Gene Symbol: SPINT1
  Gene Name: serine peptidase inhibitor, Kunitz type 1
  ENSP ID: ENSP00000456015
  MOD_RES (1)..(1): Any amino acid
XVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPDTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVV

SEQ ID NO: 77689 - protein, 313 aa, Homo sapiens
  Payload ID: 15485
  Gene Symbol: SPINT1
  Gene Name: serine peptidase inhibitor, Kunitz type 1
  ENSP ID: ENSP00000456769
  MOD_RES (1)..(1): Any amino acid
XEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVELTVTSSDHPEDTANVTVTVLSTKQTEDYCLASNKVGRCRGSFPRWYYDPT

SEQ ID NO: 77690 - protein, 513 aa, Homo sapiens
  Payload ID: 15485
  Gene Symbol: SPINT1
  Gene Name: serine peptidase inhibitor, Kunitz type 1
  Uniprot ID: O43278
  ENSP ID: ENSP00000457076
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 77691 - protein, 301 aa, Homo sapiens
  Payload ID: 15485
  Gene Symbol: SPINT1
  Gene Name: serine peptidase inhibitor, Kunitz type 1
  ENSP ID: ENSP00000457284
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACR

SEQ ID NO: 77692 - protein, 472 aa, Homo sapiens
  Payload ID: 15485
  Gene Symbol: SPINT1
  Gene Name: serine peptidase inhibitor, Kunitz type 1
  ENSP ID: ENSP00000458074
PPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLV

SEQ ID NO: 77693 - protein, 99 aa, Homo sapiens
  Payload ID: 15486
  Gene Symbol: SPINT4
  Gene Name: serine peptidase inhibitor, Kunitz type 4
  Uniprot ID: Q6UDR6
  ENSP ID: ENSP00000279058
MKSAKLGFLLRFFIFCSLNTLLLGGVNKIAEKICGDLKDPCKLDMNFGSCYEVHFRYFYNRTSKRCETFVFSGCNGNLNNFKLKIEREVACVAKYKPPR

SEQ ID NO: 77694 - protein, 252 aa, Homo sapiens
  Payload ID: 15487
  Gene Symbol: SPINT2
  Gene Name: serine peptidase inhibitor, Kunitz type, 2
  Uniprot ID: O43291
  ENSP ID: ENSP00000301244
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 77695 - protein, 195 aa, Homo sapiens
  Payload ID: 15487
  Gene Symbol: SPINT2
  Gene Name: serine peptidase inhibitor, Kunitz type, 2
  Uniprot ID: O43291
  ENSP ID: ENSP00000389788
MAQLCGLRRSRAFLALLGSLLLSGVLAADRERSIHENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 77696 - protein, 52 aa, Homo sapiens
  Payload ID: 15487
  Gene Symbol: SPINT2
  Gene Name: serine peptidase inhibitor, Kunitz type, 2
  ENSP ID: ENSP00000465301
MPRWWYNVTDGSCQLFVYGGCDGNSNNYLTKEECLKKCATVTENATGDLATS

SEQ ID NO: 77697 - protein, 62 aa, Homo sapiens
  Payload ID: 15487
  Gene Symbol: SPINT2
  Gene Name: serine peptidase inhibitor, Kunitz type, 2
  ENSP ID: ENSP00000465561
MPRWWYNVTDGSCQLFVYGGCDGNSNNYLTKEECLKKCATVTENATGDLATSRNAADSSVPS

SEQ ID NO: 77698 - protein, 174 aa, Homo sapiens
  Payload ID: 15487
  Gene Symbol: SPINT2
  Gene Name: serine peptidase inhibitor, Kunitz type, 2
  ENSP ID: ENSP00000465721
MAQLCGLRRSRAFLALLGSLLLSGVLAADRERSIHDFCLVSKVVGRCRASMPRWWYNVTDGSCQLFVYGGCDGNSNNYLTKEECLKKCATVTAPRRQDSEDHSSDMFNYEEYCTANAVTGPCRASFPRWYFDVERNSCNNFIYGGCRGNKNSYRSEEACMLRCFRQQENPPLPL

SEQ ID NO: 77699 - protein, 202 aa, Homo sapiens
  Payload ID: 15487
  Gene Symbol: SPINT2
  Gene Name: serine peptidase inhibitor, Kunitz type, 2
  ENSP ID: ENSP00000466407
MPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 77700 - protein, 106 aa, Homo sapiens
  Payload ID: 15487
  Gene Symbol: SPINT2
  Gene Name: serine peptidase inhibitor, Kunitz type, 2
  ENSP ID: ENSP00000468519
  MOD_RES (1)..(1): Any amino acid
XRGTPAITSSMEAAGAIRTATALRRPACSAASAVCSLPGQQENPPLPLGSKVVVLAGLFVMVLILFLGASMVYLIRVARRNQERALRTVWSSGDDKEQLVKNTYVL

SEQ ID NO: 77701 - protein, 130 aa, Homo sapiens
  Payload ID: 15487
  Gene Symbol: SPINT2
  Gene Name: serine peptidase inhibitor, Kunitz type, 2
  ENSP ID: ENSP00000468728
  MOD_RES (1)..(1): Any amino acid
XPRRQDSEDHSSDMFNYEEYCTANAVTGPCRASFPRWYFDVERNSCNNFIYGGCRGNKNSYRSEEACMLRCFRQQENPPLPLGSKGKWPLTLLLPSACLLPSLTELSPAQLWFTLSFTVNIILAESHVSA

SEQ ID NO: 77702 - protein, 89 aa, Homo sapiens
  Payload ID: 15488
  Gene Symbol: SPINT3
  Gene Name: serine peptidase inhibitor, Kunitz type, 3
  Uniprot ID: P49223
  ENSP ID: ENSP00000217428
MQLQASLSFLLILTLCLELRSELARDTIKDLLPNVCAFPMEKGPCQTYMTRWFFNFETGECELFAYGGCGGNSNNFLRKEKCEKFCKFT

SEQ ID NO: 77703 - protein, 340 aa, Homo sapiens
  Payload ID: 15489
  Gene Symbol: SRR
  Gene Name: serine racemase
  Uniprot ID: Q9GZT4
  ENSP ID: ENSP00000339435
MCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDESRENVAKRVTEETEGIMVHPNQEPAVIAGQGTIALEVLNQVPLVDALVVPVGGGGMLAGIAITVKALKPSVKVYAAEPSNADDCYQSKLKGKLMPNLYPPETIADGVKSSIGLNTWPIIRDLVDDIFTVTEDEIKCATQLVWERMKLLIEPTAGVGVAAVLSQHFQTVSPEVKNICIVLSGGNVDLTSSITWVKQAERPASYQSVSV

SEQ ID NO: 77704 - protein, 66 aa, Homo sapiens
  Payload ID: 15489
  Gene Symbol: SRR
  Gene Name: serine racemase
  ENSP ID: ENSP00000458814
MCAQYCISFADVEKAHINIRDSIHLTPVLTSSILNQLTGRNLFFKCELFQKTGSFKIRGALNAVRS

SEQ ID NO: 77705 - protein, 100 aa, Homo sapiens
  Payload ID: 15489
  Gene Symbol: SRR
  Gene Name: serine racemase
  ENSP ID: ENSP00000460581
MCAQYCISFADVEKAHINIRDSIHLTPVLTSSILNQLTGRNLFFKCELFQKTGSFKIRGALNAVRSLVPDALERKPKAVVTHSSGNHGQALTYAAKLEGI

SEQ ID NO: 77706 - protein, 150 aa, Homo sapiens
  Payload ID: 15489
  Gene Symbol: SRR
  Gene Name: serine racemase
  ENSP ID: ENSP00000461125
MCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDESKLKGKLMPNLYPPETI

SEQ ID NO: 77707 - protein, 78 aa, Homo sapiens
  Payload ID: 15489
  Gene Symbol: SRR
  Gene Name: serine racemase
  ENSP ID: ENSP00000461343
MVHPNQEPAVIAGQGTIALEVLNQVPLVDALVVPVGGGGMLAGIAITVKALKPSVKVYAAEPSNADDCYQSKLKGKLM

SEQ ID NO: 77708 - protein, 66 aa, Homo sapiens; identical to SEQ ID NO: 77704
  Payload ID: 15489
  Gene Symbol: SRR
  Gene Name: serine racemase
  ENSP ID: ENSP00000461482

SEQ ID NO: 77709 - protein, 93 aa, Homo sapiens
  Payload ID: 15489
  Gene Symbol: SRR
  Gene Name: serine racemase
  ENSP ID: ENSP00000461589
MCAQYCISFADVEKAHINIRDSIHLTPVLTSSILNQLTGRNLFFKCELFQKTGSFKIRGALNAVRSLVPDALERKPKAVVTHSSGNHGQALTY

SEQ ID NO: 77710 - protein, 114 aa, Homo sapiens
  Payload ID: 15489
  Gene Symbol: SRR
  Gene Name: serine racemase
  ENSP ID: ENSP00000476682
MPNLYPPETIADGVKSSIGLNTWPIIRDLVDDIFTVTEDEIKCATQLVWERMKLLIEPTAGVGVAAVLSQHFQTVSPEVKNICIVLSGGNVDLTSSITWVKQAERPASYQSVSV

SEQ ID NO: 77711 - protein, 545 aa, Homo sapiens
  Payload ID: 15490
  Gene Symbol: STK39
  Gene Name: serine threonine kinase 39
  Uniprot ID: Q9UEW8
  ENSP ID: ENSP00000348278
MAEPSGSPVHVQLPQQAAPVTAAAAAAPAAATAAPAPAAPAAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 77712 - protein, 904 aa, Homo sapiens
  Payload ID: 15491
  Gene Symbol: SRRM1
  Gene Name: serine/arginine repetitive matrix 1
  Uniprot ID: Q8IYB3
  ENSP ID: ENSP00000326261
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 77713 - protein, 913 aa, Homo sapiens
  Payload ID: 15491
  Gene Symbol: SRRM1
  Gene Name: serine/arginine repetitive matrix 1
  ENSP ID: ENSP00000363510
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 77714 - protein, 820 aa, Homo sapiens [sequence omitted]

SEQ ID NO: 77715 - protein, 101 aa, Homo sapiens
  Payload ID: 15491
  Gene Symbol: SRRM1
  Gene Name: serine/arginine repetitive matrix 1
  ENSP ID: ENSP00000469151
MSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEK

SEQ ID NO: 77716 - protein, 681 aa, Homo sapiens
  Payload ID: 15491
  Gene Symbol: SRRM1
  Gene Name: serine/arginine repetitive matrix 1
  ENSP ID: ENSP00000471084
MSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRMQMGKRWQSPVTKSGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSP

SEQ ID NO: 77717 - protein, 79 aa, Homo sapiens
  Payload ID: 15491
  Gene Symbol: SRRM1
  Gene Name: serine/arginine repetitive matrix 1
  ENSP ID: ENSP00000471819
MDAGFFRGTSAEQDNRFSNKQKKLLKQLKFAECLEKKVDMSKVNLEVIKPWITKRVTEILGFEDDVVIEFIFNQLEVKA

SEQ ID NO: 77718 - protein, 2752 aa, Homo sapiens
  Payload ID: 15492
  Gene Symbol: SRRM2
  Gene Name: serine/arginine repetitive matrix 2
  Uniprot ID: Q9UQ35
  ENSP ID: ENSP00000301740
MYNGIGLPTPRGSGTNGYVQRNLSLVRGRRGERPDYKGEEELRRLEAALVKRPNPDILDHERKRRVELRCLELEEMMEEQGYEEQQIQEKVATFRLMLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPPSEASPTRDRSPPKSPEKLPQSSSSESSPPSPQPTKVSRHASSSPESPKPAPAPGSHREISSSPTSKNRSHGRAKRDKSHSHTPSRRMGRSRSPATAKRGRSRSRTPTKRGHSRSRSPQWRRSRSAQRWGRSRSPQRRGRSRSPQRPGWSRSRNTQRRGRSRSARRGRSHSRSPATRGRSRSRTPARRGRSRSRTPARRRSRSRTPTRRRSRSRTPARRGRSRSRTPARRRSRTRSPVRRRSRSRSPARRSGRSRSRTPARRGRSRSRTPARRGRSRSRTPARRSGRSRSRTPARRGRSRSRTPRRGRSRSRSLVRRGRSHSRTPQRRGRSGSSSERKNKSRTSQRRSRSNSSPEMKKSRISSRRSRSLSSPRSKAKSRLSLRRSLSGSSPCPKQKSQTPPRRSRSGSSQPKAKSRTPPRRSRSSSSPPPKQKSKTPSRQSHSSSSPHPKVKSGTPPRQGSITSPQANEQSVTPQRRSCFESSPDPELKSRTPSRHSCSGSSPPRVKSSTPPRQSPSRSSSPQPKVKAIISPRQRSHSGSSSPSPSRVTSRTTPRRSRSVSPCSNVESRLLPRYSHSGSSSPDTKVKPETPPRQSHSGSISPYPKVKAQTPPGPSLSGSKSPCPQEKSKDSLVQSCPGSLSLCAGVKSSTPPGESYFGVSSLQLKGQSQTSPDHRSDTSSPEVRQSHSESPSLQSKSQTSPKGGRSRSSSPVTELASRSPIRQDRGEFSASPMLKSGMSPEQSRFQSDSSSYPTVDSNSLLGQSRLETAESKEKMALPPQEDATASPPRQKDKFSPFPVQDRPESSLVFKDTLRTPPRERSGAGSSPETKEQNSALPTSSQDEELMEVVEKSEEPAGQILSHLSSELKEMSTSNFESSPEVEERPAVSLTLDQSQSQASLEAVEVPSMASSWGGPHFSPEHKELSNSPLRENSFGSPLEFRNSGPLGTEMNTGFSSEVKEDLNGPFLNQLETDPSLDMKEQSTRSSGHSSSELSPDAVEKAGMSSNQSISSPVLDAVPRTPSRERSSSASSPEMKDGLPRTPSRRSRSGSSPGLRDGSGTPSRHSLSGSSPGMKDIPRTPSRGRSECDSSPEPKALPQTPRPRSRSPSSPELNNKCLTPQRERSGSESSVDQKTVARTPLGQRSRSGSSQELDVKPSASPQERSESDSSPDSKAKTRTPLRQRSRSGSSPEVDSKSRLSPRRSRSGSSPEVKDKPRAAPRAQSGSDSSPEPKAPAPRALPRRSRSGSSSKGRGPSPEGSSSTESSPEHPPKSRTARRGSRSSPEPKTKSRTPPRRRSSRSSPELTRKARLSRRSRSASSSPETRSRTPPRHRRSPSVSSPEPAEKSRSSRRRRSASSPRTKTTSRRGRSPSPKPRGLQRSRSRSRREKTRTTRRRDRSGSSQSTSRRRQRSRSRSRVTRRRRGGSGYHSRSPARQESSRTSSRRRRGRSRTPPTSRKRSRSRTSPAPWKRSRSRASPATHRRSRSRTPLISRRRSRSRTSPVSRRRSRSRTSVTRRRSRSRASPVSRRRSRSRTPPVTRRRSRSRTPTTRRRSRSRTPPVTRRRSRSRTPPVTRRRSRSRTSPITRRRSRSRTSPVTRRRSRSRTSPVTRRRSRSRTSPVTRRRSRSRTPPAIRRRSRSRTPLLPRKRSRSRSPLAIRRRSRSRTPRTARGKRSLTRSPPAIRRRSASGSSSDRSRSATPPATRNHSGSRTPPVALNSSRMSCFSRPSMSPTPLDRCRSPGMLEPLGSSRTPMSVLQQAGGSMMDGPGPRIPDHQRTSVPENHAQSRIALALTAISLGTARPPPSMSAAGLAARMSQVPAPVPLMSLRTAPAANLASRIPAASAAAMNLASARTPAIPTAVNLADSRTPAAAAAMNLASPRTAVAPSAVNLADPRTPTAPAVNLAGARTPAALAALSLTGSGTPPTAANYPSSSRTPQAPASANLVGPRSAHATAPVNIAGSRTAAALAPASLTSARMAPALSGANLTSPRVPLSAYERVSGRTSPPLLDRARSRTPPSAPSQSRMTSERAPSPSSRMGQAPSQSLLPPAQDQPRSPVPSAFSDQSRCLIAQTTPVAGSQSLSSGAVATTTSSAGDHNGMLSVPAPGVPHSDVGEPPASTGAQQPSALAALQPAKERRSSSSSSSSSSSSSSSSSSSSSSSSSGSSSSDSEGSSLPVQPEVALKRVPSPTPAPKEAVREGRPPEPTPAKRKRRSSSSSSSSSSSSSSSSSSSSSSSSSSSSSSSSSSSSSSSSSSPSPAKPGPQALPKPASPKKPPPGERRSRSPRKPIDSLRDSRSLSYSPVERRRPSPQPSPRDQQSSSSERGSRRGQRGDSRSPSHKRRRETPSPRPMRHRSSRSP

SEQ ID NO: 77719 - protein, 115 aa, Homo sapiens
  Payload ID: 15492
  Gene Symbol: SRRM2
  Gene Name: serine/arginine repetitive matrix 2
  ENSP ID: ENSP00000458230
MYNGIGLPTPRGSGTNGYVQRNLSLVRGRRGERPDYKGEEELRRLEAALVKRPNPDILDHERKRRVELRCLELEEMMEEQGYEEQQIQEKVATFRLMLLEKDVNPGGKEETPGQR

SEQ ID NO: 77720 - protein, 895 aa, Homo sapiens
  Payload ID: 15492
  Gene Symbol: SRRM2
  Gene Name: serine/arginine repetitive matrix 2
  ENSP ID: ENSP00000458647
MLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPPSEASPTRDRSPPKSPEKLPQSSSSESSPPSPQPTKVSRHASSSPESPKPAPAPGSHREISSSPTSKNRSHGRAKRDKSHSHTPSRRMGRSRSPATAKRGRSRSRTPTKRGHSRSRSPQWRRSRSAQRWGRSRSPQRRGRSRSPQRPGWSRSRNTQRRGRSRSARRGRSHSRSPATRGRSRSRTPARRGRSRSRTPARRRSRSRTPTRRRSRSRTPARRGRSRSRTPARRRSRTRSPVRRRSRSRSPARRSGRSRSRTPARRGRSRSRTPARRGRSRSRTPARRSGRSRSRTPARRGRSRSRTPRRGRSRSRSLVRRGRSHSRTPQRRGRSGSSSERKNKSRTSQRRSRSNSSPEMKKSRISSRRSRSLSSPRSKAKSRLSLRRSLSGSSPCPKQKSQTPPRRSRSGSSQPKAKSRTPPRRSRSSSSPPPKQKSKTPSRQSHSSSSPHPKVKSGTPPRQGSITSPQANEQSVTPQRRSCFESSPDPELKSRTPSRHSCSGSSPPRVKSSTPPRQSPSRSSSPQPKVKAIISPRQRSHSGSSSPSPSRVTSRTTPRRSRSVSPCSNVESRLLPRYSHSGSSSPDTKVKPETPPRQSHSG

SEQ ID NO: 77721 - protein, 94 aa, Homo sapiens
  Payload ID: 15492
  Gene Symbol: SRRM2
  Gene Name: serine/arginine repetitive matrix 2
  ENSP ID: ENSP00000458718
MLLEKDVNPGGKEETPGQRPAVTETHQLAELNEKKNERLRAAFGISDSYVDGSSFDPQRRAREAKQPAPEPPKPYSLVRESSSSRSPTPKQKKK

SEQ ID NO: 77722 - protein, 297 aa, Homo sapiens
  Payload ID: 15492
  Gene Symbol: SRRM2
  Gene Name: serine/arginine repetitive matrix 2
  ENSP ID: ENSP00000458870
MLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNP

SEQ ID NO: 77723 - protein, 41 aa, Homo sapiens
  Payload ID: 15492
  Gene Symbol: SRRM2
  Gene Name: serine/arginine repetitive matrix 2
  ENSP ID: ENSP00000459157
QGVSLLPQQSRGRVLVCSPLNLGSPWMEGSLSLPFFFSLFL

SEQ ID NO: 77724 - protein, 184 aa, Homo sapiens
  Payload ID: 15492
  Gene Symbol: SRRM2
  Gene Name: serine/arginine repetitive matrix 2
  ENSP ID: ENSP00000460642
  MOD_RES (1)..(1): Any amino acid
XPPLLDRARSRTPPSAPSQSRMTSERAPSPSSRMGQAPSQSLLPPAQDQPRSPVPSAFSDQSRCLIAQTTPVAGSQSLSSGAVATTTSSAGDHNGMLSVPAPGVPHSDVGEPPASTGAQQPSALAALQPAKERRSSSSSSSSSSSSSSSSSSSSSSSSSGSSSSDSEGSSLPVQPEVALKRGQN

SEQ ID NO: 77725 - protein, 1018 aa, Homo sapiens
  Payload ID: 15492
  Gene Symbol: SRRM2
  Gene Name: serine/arginine repetitive matrix 2
  ENSP ID: ENSP00000461181
MYNGIGLPTPRGSGTNGYVQRNLSLVRGRRGERPDYKGEEELRRLEAALVKRPNPDILDHERKRRVELRCLELEEMMEEQGYEEQQIQEKVATFRLMLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPPSEASPTRDRSPPKSPEKLPQSSSSESSPPSPQPTKVSRHASSSPESPKPAPAPGSHREISSSPTSKNRSHGRAKRDKSHSHTPSRRMGRSRSPATAKRGRSRSRTPTKRGHSRSRSPQWRRSRSAQRWGRSRSPQRRGRSRSPQRPGWSRSRNTQRRGRSRSARRGRSHSRSPATRGRSRSRTPARRGRSRSRTPARRRSRSRTPTRRRSRSRTPARRGRSRSRTPARRRSRTRSPVRRRSRSRSPARRSGRSRSRTPARRGRSRSRTPARRGRSRSRTPARRSGRSRSRTPARRGRSRSRTPRRGRSRSRSLVRRGRSHSRTPQRRGRSGSSSERKNKSRTSQRRSRSNSSPEMKKSRISSRRSRSLSSPRSKAKSRLSLRRSLSGSSPCPKQKSQTPPRRSRSGSSQPKAKSRTPPRRSRSSSSPPPKQKSKTPSRQSHSSSSPHPKVKSGTPPRQGSITSPQANEQSVTPQRRSCFESSPDPELKSRTPSRHSCSGSSPPRVKSSTPPRQSPSRSSSPQPKVKAIISPRQRSHSGSSSPSPSRVTSRTTPRRSRSVSPCSNVESRLLPRYSHSGSSSPDTKVKPETPPRQSHSGSISPYPKVKAQTPPGPSLSGSKSPCPQ

SEQ ID NO: 77726 - protein, 78 aa, Homo sapiens
  Payload ID: 15492
  Gene Symbol: SRRM2
  Gene Name: serine/arginine repetitive matrix 2
  ENSP ID: ENSP00000461535
  MOD_RES (1)..(1): Any amino acid
XRSPRKPIDSLRDSRSLSYSPVERRRPSPQPSPRDQQSSSSERGSRRGQRGDSRSPSHKRRRETPSPRPMRHRSSRSP

SEQ ID NO: 77727 - protein, 251 aa, Homo sapiens
  Payload ID: 15492
  Gene Symbol: SRRM2
  Gene Name: serine/arginine repetitive matrix 2
  ENSP ID: ENSP00000484503
MLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEVCS

SEQ ID NO: 77728 - protein, 311 aa, Homo sapiens
  Payload ID: 15492
  Gene Symbol: SRRM2
  Gene Name: serine/arginine repetitive matrix 2
  Uniprot ID: Q9UQ35
  ENSP ID: ENSP00000487247
MLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPSPQLFMFLKGILVF

SEQ ID NO: 77729 - protein, 653 aa, Homo sapiens
  Payload ID: 15493
  Gene Symbol: SRRM3
  Gene Name: serine/arginine repetitive matrix 3
  ENSP ID: ENSP00000480851
MSSTVNNGAASMQSTPDAANGFPQPSSSSGTWPRAEEELRAAEPGLVKRAHREILDHERKRRVELKCMELQEMMEEQGYSEEEIRQKVGTFRQMLMEKEGVLTREDRPGGHIVAETPRLTEGAEPGLEYAPFDDDDGPVDCDCPASCYRGHRGYRTKHWSSSSASPPPKKKKKKKGGHRRSRKKRRLESECSCGSSSPLRKKKKSVKKHRRDRSDSGSRRKRRHRSRSSKCKRKEKNKEKKRPHTESPGRRSHRHSSGSSHSPSLSSHYSDSRSPSRLSPKHRDEGRKTGSQRSSGSRSPSPSGGSGWGSPQRNGGSGQRSGAHGGRPGSAHSPPDKPSSPSPRVRDKAAAAAPTPPARGKESPSPRSAPSSQGRGGRAAGGAGRRRRRRRRRRRSRSSASAPRRRGRRRPRPAPPRGSSRSLSRARSSSDSGSGRGAPGPGPEPGSERGHGGHGKRAKERPPRARPASTSPSPGAHGRRGGPEGKSSSRSPGPHPRSWSSSRSPSKSRSRSAEKRPHSPSRSPSPKKPLSRDKDGEGRARHSEAEATRARRRSRSYSPIRKRRRDSPSFMEPRRITSARKRPIPYYRPSPSSSSSCLSSDYSTRSHSRSPSPGHSHGSYSSRSHGTRSRTRSPSRTPSPSYHSRSSSESGGF

SEQ ID NO: 77730 - protein, 109 aa, Homo sapiens
  Payload ID: 15493
  Gene Symbol: SRRM3
  Gene Name: serine/arginine repetitive matrix 3
  ENSP ID: ENSP00000483698
SGSSHSPSLSSHYSDSRSPSRLSPKHRDEGRKTGSQRSSGSRSPSPSGGSGWGSPQRNGGSGQRSGAHGGRPGSAHSPPDVRTLRFAEGSRAAGCAVRGRAGRQRGRGR

SEQ ID NO: 77731 - protein, 611 aa, Homo sapiens
  Payload ID: 15494
  Gene Symbol: SRRM4
  Gene Name: serine/arginine repetitive matrix 4
  Uniprot ID: A7MD48
  ENSP ID: ENSP00000267260
MASVQQGEKQLFEKFWRGTFKAVATPRPESIIVASITARKPLPRTEPQNNPVVPAQDGPSEKLGQHLATEPLGTNSWERDKTCRELGATRGHSASHDKDLTPPPSSRGKKKKKKSTRKKRRRSSSYSPSPVKKKKKKSSKKHKRRRSFSKKRRHSSSSPKSKRRDEKRHKKQSRSRPRKSHRHRHHRCPSRSQSSESRPSSCESRHRGRSPEEGQKSRRRHSRRCSKTLCKDSPEAQSSRPPSQPLQMLGYLSARGVITGSGSAADLFTKTASPLTTSRGRSQEYDSGNDTSSPPSTQTSSARSRGQEKGSPSGGLSKSRELNSGNTSDSGNSFTTSSPQNKGAMLENLSPTSRGRESRGFQSPCLECAEVKKSSLVPSTARSSPMKGCSRSSSYASTRSSSHSSRSPNPRASPRYTQSRSTSSEKRSYSRSPSYSSKSGKRSPPSRSSRSRRSPSYSRYSPSRERDPKYSEKDSQQRERERARRRRRSYSPMRKRRRDSPSHLEARRITSARKRPIPYYRPSPSSSGSLSSTSSWYSSSSSRSASRSYSRSRSRSRSRRRSRTRTSSSSSSRSPSPGSRSRSRSRSRSRSRSRSQSRSYSSADSYSSTRR

SEQ ID NO: 77732 - protein, 715 aa, Homo sapiens
  Payload ID: 15495
  Gene Symbol: SRRM5
  Gene Name: serine/arginine repetitive matrix 5
  Uniprot ID: B3KS81
  ENSP ID: ENSP00000414512
MSSPKRSSKPSMSLAPSGSSMPTADPKPPASLKSTKSATPNRSLVPTKPATSRNSVMSPSSSKSTKSTSTKRAPSNRPSSRSRVRSKARTPSRVSTDTRTSKASKASDVRCHQRRGTHSRGRTPGRRGSRSSKRSPSRASTPGRIRTHGARPGMASRVRTPTSQQKGSRGKSYGRPRTSNRERSDSQPRNLSKKSYRPPGGSGIGRSSELAVTPSTAKCQTPTGIPSKEKSDNPSPSSSRKVKSYGQMIIPSREKSYSPTEMSSRVKSYNQASTRSRPQSHSQSRSPRRSRSGSQKRTHSRVRSHSWKRNHSRARSRTRKGILSQMGRHSQSRSHSKGKSQNQSRTPRRGRSHNWSRNPSKERSHSHSRSSSKERDHRGSSSPRKESGRSQSGSPNKQRDHSRSRSPNKARDRSRSRSPYKARDRSRSRSPNKARDCSRSRSPYKARDRSRSRSPNKARDHSRSRSPNKARDRSRSRSPSKERDHSQLGSPSKERDHRRSRSPSKERQCRQSRSSSKERDHRRSRSPSKERQRRQSRSPNKERDRSQSRSPSEEREHRQSRSPSKERDRRRWRSPSKERERRQSRSSSEERDHSRSRSPNKQSGYSRPRASSKEKAHSRSRTPSKEGNHSQSRTSSKESDPSQSTVPRSPDWKRSPTRTSSLSQNRTPSKTSSHSPSTFPSGGQTLSQDDSQADATTSKATLPGERSSSSSSKLA

SEQ ID NO: 77733 - protein, 715 aa, Homo sapiens; identical to SEQ ID NO: 77732
  Payload ID: 15495
  Gene Symbol: SRRM5
  Gene Name: serine/arginine repetitive matrix 5
  Uniprot ID: B3KS81
  ENSP ID: ENSP00000476253

SEQ ID NO: 77734 - protein, 248 aa, Homo sapiens
  Payload ID: 15496
  Gene Symbol: SRSF1
  Gene Name: serine/arginine-rich splicing factor 1
  Uniprot ID: Q07955
  ENSP ID: ENSP00000258962
MSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEGETAYIRVKVDGPRSPSYGRSRSRSRSRSRSRSRSNSRSRSYSPRRSRGSPRYSPRHSRSRSRT

SEQ ID NO: 77735 - protein, 201 aa, Homo sapiens
  Payload ID: 15496
  Gene Symbol: SRSF1
  Gene Name: serine/arginine-rich splicing factor 1
  Uniprot ID: Q07955
  ENSP ID: ENSP00000462215
MSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEVGYTRILFFDQNWIQWS

SEQ ID NO: 77736 - protein, 143 aa, Homo sapiens
  Payload ID: 15496
  Gene Symbol: SRSF1
  Gene Name: serine/arginine-rich splicing factor 1
  ENSP ID: ENSP00000462616
  MOD_RES (1)..(1): Any amino acid
XAPRGRYGPPSRRSENRVVVSGLPPSGSWQDLKDHMREAGDVCYADVYRDGTGVVEFVRKEDMTYAVRKLDNTKFRSHEGETAYIRVKVDGPRSPSYGRSRSRSRSRSRSRSRSNSRSRSYSPRRSRGSPRYSPRHSRSRSRT

SEQ ID NO: 77737 - protein, 73 aa, Homo sapiens
  Payload ID: 15496
  Gene Symbol: SRSF1
  Gene Name: serine/arginine-rich splicing factor 1
  ENSP ID: ENSP00000462687
MSGGGVIRGPAGNNDCRIYVGNLPPDIRTKDIEDVFYKYGAIRDIDLKNRRGGPPFAFVEFEDPRDAEDAVHI

SEQ ID NO: 77738 - protein, 253 aa, Homo sapiens
  Payload ID: 15496
  Gene Symbol: SRSF1
  Gene Name: serine/arginine-rich splicing factor 1
  ENSP ID: ENSP00000463042
MSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEGETAYIRVKVDGPRSPSYGRSRSRSRSRSRSRSRSNSRSRSYSPRRSRGSPRYSPRHSRSRSHISEEMD

SEQ ID NO: 77739 - protein, 201 aa, Homo sapiens; identical to SEQ ID NO: 77735
  Payload ID: 15496
  Gene Symbol: SRSF1
  Gene Name: serine/arginine-rich splicing factor 1
  Uniprot ID: Q07955
  ENSP ID: ENSP00000463223

SEQ ID NO: 77740 - protein, 65 aa, Homo sapiens
  Payload ID: 15496
  Gene Symbol: SRSF1
  Gene Name: serine/arginine-rich splicing factor 1
  ENSP ID: ENSP00000463917
MSGGGVIRGPAGNNDCRIYVGNLPPDIRTKDIEDVFYKYGAIRDIDLKNRRGGPPFAFVEFEDPR

SEQ ID NO: 77741 - protein, 183 aa, Homo sapiens
  Payload ID: 15497
  Gene Symbol: SRSF10
  Gene Name: serine/arginine-rich splicing factor 10
  Uniprot ID: O75494
  ENSP ID: ENSP00000342913
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRPNCSWNTQYSSAYYTSRKI

SEQ ID NO: 77742 - protein, 261 aa, Homo sapiens
  Payload ID: 15497
  Gene Symbol: SRSF10
  Gene Name: serine/arginine-rich splicing factor 10
  Uniprot ID: O75494
  ENSP ID: ENSP00000344149
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 77743 - protein, 173 aa, Homo sapiens
  Payload ID: 15497
  Gene Symbol: SRSF10
  Gene Name: serine/arginine-rich splicing factor 10
  Uniprot ID: O75494
  ENSP ID: ENSP00000363576
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDSQVSKKKNER

SEQ ID NO: 77744 - protein, 172 aa, Homo sapiens
  Payload ID: 15497
  Gene Symbol: SRSF10
  Gene Name: serine/arginine-rich splicing factor 10
  ENSP ID: ENSP00000363577
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNRPTGRPRRSRSHSDNDSQVSKKKNER

SEQ ID NO: 77745 - protein, 182 aa, Homo sapiens
  Payload ID: 15497
  Gene Symbol: SRSF10
  Gene Name: serine/arginine-rich splicing factor 10
  Uniprot ID: O75494
  ENSP ID: ENSP00000388991
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNRPTGRPRRSRSHSDNDRPNCSWNTQYSSAYYTSRKI

SEQ ID NO: 77746 - protein, 165 aa, Homo sapiens
  Payload ID: 15497
  Gene Symbol: SRSF10
  Gene Name: serine/arginine-rich splicing factor 10
  Uniprot ID: O75494
  ENSP ID: ENSP00000419813
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRKPNCSWNTQYSSAYYTSRKI

SEQ ID NO: 77747 - protein, 262 aa, Homo sapiens
  Payload ID: 15497
  Gene Symbol: SRSF10
  Gene Name: serine/arginine-rich splicing factor 10
  Uniprot ID: O75494
  ENSP ID: ENSP00000420195
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 77748 - protein, 69 aa, Homo sapiens
  Payload ID: 15497
  Gene Symbol: SRSF10
  Gene Name: serine/arginine-rich splicing factor 10
  ENSP ID: ENSP00000473291
MSRYLRPPNTSLFVRNVADDTRSEDLRREFGRYGPIVDVYVPLDFYTRRPRGFAYVQYPFFRWLISEGC

SEQ ID NO: 77749 - protein, 40 aa, Homo sapiens
  Payload ID: 15497
  Gene Symbol: SRSF10
  Gene Name: serine/arginine-rich splicing factor 10
  ENSP ID: ENSP00000473293
MSRYLRPPNTSLFVRNVADDTSTKSDESQGREECVQFFTL

SEQ ID NO: 77750 - protein, 424 aa, Homo sapiens
  Payload ID: 15498
  Gene Symbol: SRSF11
  Gene Name: serine/arginine-rich splicing factor 11
  ENSP ID: ENSP00000359987
MINNHRNQALYFSEHKYFQQTQVVYQGDIFWVFLCVFCLRKECVLMQGCFSAGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 77751 - protein, 484 aa, Homo sapiens
  Payload ID: 15498
  Gene Symbol: SRSF11
  Gene Name: serine/arginine-rich splicing factor 11
  Uniprot ID: Q05519
  ENSP ID: ENSP00000359988
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 77752 - protein, 483 aa, Homo sapiens
  Payload ID: 15498
  Gene Symbol: SRSF11
  Gene Name: serine/arginine-rich splicing factor 11
  Uniprot ID: Q05519
  ENSP ID: ENSP00000359989
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEGVIPDEAKALSLLAPANAVAGLLPGGGLLPTPNPLTQIGAVPLAALGAPTLDPALAALGLPGANLNSQSLAADQLLKLMSTVDPKLNHVAAGLVSPSLKSDTSSKEIEEAMKRVREAQSLISAAIEPDKKEEKRRHSRSRSRSRRRRTPSSSRHRRSRSRSRRRSHSKSRSRRRSKSPRRRRSHSRERGRRSRSTSKTRDKKKEDKEKKRSKTPPKSYSTARRSRSASRERRRRRSRSGTRSPKKPRSPKRKLSRSPSPRRHKKEKKKDKDKERSRDERERSTSKKKKSKDKEKDRERKSESDKDVKVTRDYDEEEQGYDSEKEKKEEKKPIETGSPKTKECSVEKGTGDSLRESKVNGDDHHEEDMDMSD

SEQ ID NO: 77753 - protein, 389 aa, Homo sapiens [sequence omitted]

SEQ ID NO: 77754 - protein, 80 aa, Homo sapiens
  Payload ID: 15498
  Gene Symbol: SRSF11
  Gene Name: serine/arginine-rich splicing factor 11
  ENSP ID: ENSP00000474149
MSNTTVVPSTAGPGPSGGPGGGGGGGGGGGGTEVIQVTNVSPSASSEQMRTLFGFLGKIDELRLFPPDSMIQTQQLWHSI

SEQ ID NO: 77755 - protein, 128 aa, Homo sapiens
  Payload ID: 15498
  Gene Symbol: SRSF11
  Gene Name: serine/arginine-rich splicing factor 11
  ENSP ID: ENSP00000474372
MSNTTVVPSTAGPGPSGGPGGGGGGGGGGGGTEVIQVTNVSPSASSEQMRTLFGFLGKIDELRLFPPDDSPLPVSSRVCFVKFHDPDSAVVAQHLTNTVFVDRALIVVPYAEVKQPTRVVVHKTAFES

SEQ ID NO: 77756 - protein, 261 aa, Homo sapiens
  Payload ID: 15499
  Gene Symbol: SRSF12
  Gene Name: serine/arginine-rich splicing factor 12
  Uniprot ID: Q8WXF0
  ENSP ID: ENSP00000414302
MSRYTRPPNTSLFIRNVADATRPEDLRREFGRYGPIVDVYIPLDFYTRRPRGFAYVQFEDVRDAEDALYNLNRKWVCGRQIEIQFAQGDRKTPGQMKSKERHPCSPSDHRRSRSPSQRRTRSRSSSWGRNRRRSDSLKESRHRRFSYSQSKSRSKSLPRRSTSARQSRTPRRNFGSRGRSRSKSLQKRSKSIGKSQSSSPQKQTSSGTKSRSHGRHSDSIARSPCKSPKGYTNSETKVQTAKHSHFRSHSRSRSYRHKNSW

SEQ ID NO: 77757 - protein, 41 aa, Homo sapiens
  Payload ID: 15499
  Gene Symbol: SRSF12
  Gene Name: serine/arginine-rich splicing factor 12
  ENSP ID: ENSP00000427982
MSRYTRPPNTSLFIRNVADATRSKAVHSSWQAPPSLNQPVS

SEQ ID NO: 77758 - protein, 42 aa, Homo sapiens
  Payload ID: 15499
  Gene Symbol: SRSF12
  Gene Name: serine/arginine-rich splicing factor 12
  ENSP ID: ENSP00000430513
MSRYTRPPNTSLFIRNVADATRRSKAVHSSWQAPPSLNQPVS

SEQ ID NO: 77759 - protein, 133 aa, Homo sapiens
  Payload ID: 15500
  Gene Symbol: SRSF2
  Gene Name: serine/arginine-rich splicing factor 2
  ENSP ID: ENSP00000350877
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSRSRSRSRSRSRS

SEQ ID NO: 77760 - protein, 221 aa, Homo sapiens
  Payload ID: 15500
  Gene Symbol: SRSF2
  Gene Name: serine/arginine-rich splicing factor 2
  Uniprot ID: Q01130
  ENSP ID: ENSP00000353089
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 77761 - protein, 221 aa, Homo sapiens; identical to SEQ ID NO: 77760
  Payload ID: 15500
  Gene Symbol: SRSF2
  Gene Name: serine/arginine-rich splicing factor 2
  Uniprot ID: Q01130
  ENSP ID: ENSP00000376276

SEQ ID NO: 77762 - protein, 221 aa, Homo sapiens; identical to SEQ ID NO: 77760
  Payload ID: 15500
  Gene Symbol: SRSF2
  Gene Name: serine/arginine-rich splicing factor 2
  Uniprot ID: Q01130
  ENSP ID: ENSP00000391278

SEQ ID NO: 77763 - protein, 209 aa, Homo sapiens
  Payload ID: 15500
  Gene Symbol: SRSF2
  Gene Name: serine/arginine-rich splicing factor 2
  Uniprot ID: Q01130
  ENSP ID: ENSP00000441780
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 77764 - protein, 221 aa, Homo sapiens; identical to SEQ ID NO: 77760
  Payload ID: 15500
  Gene Symbol: SRSF2
  Gene Name: serine/arginine-rich splicing factor 2
  Uniprot ID: Q01130
  ENSP ID: ENSP00000462425

SEQ ID NO: 77765 - protein, 130 aa, Homo sapiens
  Payload ID: 15500
  Gene Symbol: SRSF2
  Gene Name: serine/arginine-rich splicing factor 2
  ENSP ID: ENSP00000463317
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRSRSRSRSRSRSRSRSRYSRSKS

SEQ ID NO: 77766 - protein, 164 aa, Homo sapiens
  Payload ID: 15501
  Gene Symbol: SRSF3
  Gene Name: serine/arginine-rich splicing factor 3
  Uniprot ID: P84103
  ENSP ID: ENSP00000362820
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRRSFSRSRSRSLSRDRRRERSLSRERNHKPSRSFSRSRSRSRSNERK

SEQ ID NO: 77767 - protein, 124 aa, Homo sapiens
  Payload ID: 15501
  Gene Symbol: SRSF3
  Gene Name: serine/arginine-rich splicing factor 3
  Uniprot ID: P84103
  ENSP ID: ENSP00000436036
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRVTIMSLLTTL

SEQ ID NO: 77768 - protein, 164 aa, Homo sapiens; identical to SEQ ID NO: 77766
  Payload ID: 15501
  Gene Symbol: SRSF3
  Gene Name: serine/arginine-rich splicing factor 3
  Uniprot ID: P84103
  ENSP ID: ENSP00000482833

SEQ ID NO: 77769 - protein, 95 aa, Homo sapiens
  Payload ID: 15501
  Gene Symbol: SRSF3
  Gene Name: serine/arginine-rich splicing factor 3
  ENSP ID: ENSP00000484891
MHRDSCPLDCKVYVGNLGNNGNKTELERAFGYYGPLRSVWVARNPPGFAFVEFEDPRDAADAVRELDGRLECNGVILARCNLCLLGSSDSPASAA

SEQ ID NO: 77770 - protein, 494 aa, Homo sapiens
  Payload ID: 15502
  Gene Symbol: SRSF4
  Gene Name: serine/arginine-rich splicing factor 4
  Uniprot ID: Q08170
  ENSP ID: ENSP00000362900
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKEKSRSRSHSAGKSRSKSKDQAEEKIQNNDNVGKPKSRSPSRHKSKSKSRSRSQERRVEEEKRGSVSRGRSQEKSLRQSRSRSRSKGGSRSRSRSRSKSKDKRKGRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 77771 - protein, 160 aa, Homo sapiens
  Payload ID: 15502
  Gene Symbol: SRSF4
  Gene Name: serine/arginine-rich splicing factor 4
  ENSP ID: ENSP00000473728
MPRVYIGRLSYQARERDVERFFKGYGKILEVDLKNGLLCSEPTHVFGRTRWLTLANGNQKTSESNLVVTYPQLRGASPCPKVGKDQVQTELWPTFADQESTLALIREPLVCGNCQFADVKRVPDWVMVSPEVAPQLCHSVSTATSLILTSHGEVRFLQGK

SEQ ID NO: 77772 - protein, 378 aa, Homo sapiens
  Payload ID: 15502
  Gene Symbol: SRSF4
  Gene Name: serine/arginine-rich splicing factor 4
  ENSP ID: ENSP00000485813
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSGSRSRSKSRSRSQSRSRSKKEKSRSPSKEKSRSRSHSAGKSRSKSKDQAEEKIQNNDNVGKPKSRSPSRHKSKSKSRSRSQERRVEEEKRGSVSRGRSQEKSLRQSRSRSRSKGGSRSRSRSRSKSKDKRKGRKRSREESRSRSRSRSKSERSRKRGSKRDSKAGSSKKKKKEDTDRSQSRSPS

SEQ ID NO: 77773 - protein, 45 aa, Homo sapiens
  Payload ID: 15502
  Gene Symbol: SRSF4
  Gene Name: serine/arginine-rich splicing factor 4
  ENSP ID: ENSP00000487379
  MOD_RES (1)..(1): Any amino acid
XYELNGKDLCGERVIVEHARGPRRDGSYGSGRKSFEAKMTACSIC

SEQ ID NO: 77774 - protein, 272 aa, Homo sapiens
  Payload ID: 15503
  Gene Symbol: SRSF5
  Gene Name: serine/arginine-rich splicing factor 5
  Uniprot ID: Q13243
  ENSP ID: ENSP00000377892
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNAPPVRTENRLIVENLSSRVSWQDLKDFMRQAGEVTFADAHRPKLNEGVVEFASYGDLKNAIEKLSGKEINGRKIKLIEGSKRHSRSRSRSRSRTRSSSRSRSRSRSRSRKSYSRSRSRSRSRSRSKSRSVSRSPVPEKSQKRGSSSRSKSPASVDRQRSRSRSRSRSVDSGN

SEQ ID NO: 77775 - protein, 138 aa, Homo sapiens
  Payload ID: 15503
  Gene Symbol: SRSF5
  Gene Name: serine/arginine-rich splicing factor 5
  ENSP ID: ENSP00000450918
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNAPPVRTENRLIVENLSSRVSWQPVCVVGLMTRSACGLS

SEQ ID NO: 77776 - protein, 272 aa, Homo sapiens; identical to SEQ ID NO: 77774
  Payload ID: 15503
  Gene Symbol: SRSF5
  Gene Name: serine/arginine-rich splicing factor 5
  Uniprot ID: Q13243
  ENSP ID: ENSP00000451088

SEQ ID NO: 77777 - protein, 269 aa, Homo sapiens
  Payload ID: 15503
  Gene Symbol: SRSF5
  Gene Name: serine/arginine-rich splicing factor 5
  Uniprot ID: Q13243
  ENSP ID: ENSP00000451391
MSGCRVFIGRLNPAAREKDVERFFKGYGRIRDIDLKRGFGFVDPRDADDAVYELDGKELCSERVTIEHARARSRGGRGRGRYSDRFSSRRPRNDRRNAPPVRTENRLIVENLSSRVSWQDLKDFMRQAGEVTFADAHRPKLNEGVVEFASYGDLKNAIEKLSGKEINGRKIKLIEGSKRHSRSRSRSRSRTRSSSRSRSRSRSRSRKSYSRSRSRSRSRSRSKSRSVSRSPVPEKSQKRGSSSRSKSPASVDRQRSRSRSRSRSVDSGN

SEQ ID NO: 77778 - protein, 124 aa, Homo sapiens
  Payload ID: 15503
  Gene Symbol: SRSF5
  Gene Name: serine/arginine-rich splicing factor 5
  ENSP ID: ENSP00000452090
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNAPPVRTENRLIVENLSSRVSWQVC

SEQ ID NO: 77779 - protein, 272 aa, Homo sapiens; identical to SEQ ID NO: 77774
  Payload ID: 15503
  Gene Symbol: SRSF5
  Gene Name: serine/arginine-rich splicing factor 5
  Uniprot ID: Q13243
  ENSP ID: ENSP00000452123

SEQ ID NO: 77780 - protein, 99 aa, Homo sapiens
  Payload ID: 15503
  Gene Symbol: SRSF5
  Gene Name: serine/arginine-rich splicing factor 5
  ENSP ID: ENSP00000452400
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRR

SEQ ID NO: 77781 - protein, 138 aa, Homo sapiens; identical to SEQ ID NO: 77775
  Payload ID: 15503
  Gene Symbol: SRSF5
  Gene Name: serine/arginine-rich splicing factor 5
  ENSP ID: ENSP00000452449

SEQ ID NO: 77782 - protein, 138 aa, Homo sapiens; identical to SEQ ID NO: 77775
  Payload ID: 15503
  Gene Symbol: SRSF5
  Gene Name: serine/arginine-rich splicing factor 5
  ENSP ID: ENSP00000474409

SEQ ID NO: 77783 - protein, 344 aa, Homo sapiens
  Payload ID: 15504
  Gene Symbol: SRSF6
  Gene Name: serine/arginine-rich splicing factor 6
  Uniprot ID: Q13247
  ENSP ID: ENSP00000244020
MPRVYIGRLSYNVREKDIQRFFSGYGRLLEVDLKNGYGFVEFEDSRDADDAVYELNGKELCGERVIVEHARGPRRDRDGYSYGSRSGGGGYSSRRTSGRDKYGPPVRTEYRLIVENLSSRCSWQDLKDFMRQAGEVTYADAHKERTNEGVIEFRSYSDMKRALDKLDGTEINGRNIRLIEDKPRTSHRRSYSGSRSRSRSRRRSRSRSRRSSRSRSRSISKSRSRSRSRSKGRSRSRSKGRKSRSKSKSKPKSDRGSHSHSRSRSKDEYEKSRSRSRSRSPKENGKGDIKSKSRSRSQSRSNSPLPVPPSKARSVSPPPKRATSRSRSRSRSKSRSRSRSSSRD

SEQ ID NO: 77784 - protein, 135 aa, Homo sapiens
  Payload ID: 15504
  Gene Symbol: SRSF6
  Gene Name: serine/arginine-rich splicing factor 6
  Uniprot ID: Q13247
  ENSP ID: ENSP00000433544
MPRVYIGRLSYNVREKDIQRFFSGYGRLLEVDLKNGYGFVEFEDSRDADDAVYELNGKELCGERVIVEHARGPRRDRDGYSYGSRMTNGAEAVSTEAKMTAFPDWPWLFHTLCDPCPMTLWLTLPEAMTTAAFCH

SEQ ID NO: 77785 - protein, 238 aa, Homo sapiens
  Payload ID: 15505
  Gene Symbol: SRSF7
  Gene Name: serine/arginine-rich splicing factor 7
  Uniprot ID: Q16629
  ENSP ID: ENSP00000325905
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQSPSRSRSRSRSISRPRSSRSKSRSPSPKRSRSPSGSPRRSASPERMD

SEQ ID NO: 77786 - protein, 235 aa, Homo sapiens
  Payload ID: 15505
  Gene Symbol: SRSF7
  Gene Name: serine/arginine-rich splicing factor 7
  ENSP ID: ENSP00000386806
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRSPSRSRSRSRSISRPRSSRSKSRSPSPKRSRSPSGSPRRSASPERMD

SEQ ID NO: 77787 - protein, 110 aa, Homo sapiens
  Payload ID: 15505
  Gene Symbol: SRSF7
  Gene Name: serine/arginine-rich splicing factor 7
  ENSP ID: ENSP00000392300
  MOD_RES (1)..(1): Any amino acid
XDCHRYSRRRRSRSRSRSHSRSRGRRYSRSRSRSRGRRSRSASPRRSRSISLRRSRSASLRRSRSGSIKGSRYFQSPSRSRSRSRSISRPRSSRSPSGSPRRSASPERMD

SEQ ID NO: 77788 - protein, 132 aa, Homo sapiens
  Payload ID: 15505
  Gene Symbol: SRSF7
  Gene Name: serine/arginine-rich splicing factor 7
  Uniprot ID: Q16629
  ENSP ID: ENSP00000398159
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRYLF

SEQ ID NO: 77789 - protein, 137 aa, Homo sapiens
  Payload ID: 15505
  Gene Symbol: SRSF7
  Gene Name: serine/arginine-rich splicing factor 7
  ENSP ID: ENSP00000400246
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRFLRLSQSP

SEQ ID NO: 77790 - protein, 70 aa, Homo sapiens
  Payload ID: 15505
  Gene Symbol: SRSF7
  Gene Name: serine/arginine-rich splicing factor 7
  ENSP ID: ENSP00000401202
RYSRSRSRSRGRRSRSASPRRSRSISLRRSRSASLRRSRSGSIKGSRYFHLLSSWDCHCVPQCPAEGSVP

SEQ ID NO: 77791 - protein, 226 aa, Homo sapiens
  Payload ID: 15505
  Gene Symbol: SRSF7
  Gene Name: serine/arginine-rich splicing factor 7
  Uniprot ID: Q16629
  ENSP ID: ENSP00000402264
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQSPSRSRSRSRSISRPRSSRSPSGSPRRSASPERMD

SEQ ID NO: 77792 - protein, 132 aa, Homo sapiens; identical to SEQ ID NO: 77788
  Payload ID: 15505
  Gene Symbol: SRSF7
  Gene Name: serine/arginine-rich splicing factor 7
  Uniprot ID: Q16629
  ENSP ID: ENSP00000402544

SEQ ID NO: 77793 - protein, 51 aa, Homo sapiens
  Payload ID: 15505
  Gene Symbol: SRSF7
  Gene Name: serine/arginine-rich splicing factor 7
  ENSP ID: ENSP00000408868
MPRRSRFDRPPARRPFDPNDRCYECGEKGHYAYDCHRYSRRRRSRAENLRR

SEQ ID NO: 77794 - protein, 137 aa, Homo sapiens; identical to SEQ ID NO: 77789
  Payload ID: 15505
  Gene Symbol: SRSF7
  Gene Name: serine/arginine-rich splicing factor 7
  ENSP ID: ENSP00000416516

SEQ ID NO: 77795 - protein, 282 aa, Homo sapiens
  Payload ID: 15506
  Gene Symbol: SRSF8
  Gene Name: serine/arginine-rich splicing factor 8
  Uniprot ID: Q9BRL6
  ENSP ID: ENSP00000480140
MSCGRPPPDVDGMITLKVDNLTYRTSPDSLRRVFEKYGRVGDVYIPREPHTKAPRGFAFVRFHDRRDAQDAEAAMDGAELDGRELRVQVARYGRRDLPRSRQGEPRGRSRGGGYGRRSRSYGRRSRSPRRRHRSRSRGPSCSRSRSRSRYRGSRYSRSPYSRSPYSRSRYSRSPYSRSRYRESRYGGSHYSSSGYSNSRYSRYHSSRSHSKSGSSTSSRSASTSKSSSARRSKSSSVSRSRSRSRSSSMTRSPPRVSKRKSKSRSRSKRPPKSPEEEGQMSS

SEQ ID NO: 77796 - protein, 221 aa, Homo sapiens
  Payload ID: 15507
  Gene Symbol: SRSF9
  Gene Name: serine/arginine-rich splicing factor 9
  Uniprot ID: Q13242
  ENSP ID: ENSP00000229390
MSGWADERGGEGDGRIYVGNLPTDVREKDLEDLFYKYGRIREIELKNRHGLVPFAFVRFEDPRDAEDAIYGRNGYDYGQCRLRVEFPRTYGGRGGWPRGGRNGPPTRRSDFRVLVSGLPPSGSWQDLKDHMREAGDVCYADVQKDGVGMVEYLRKEDMEYALRKLDDTKFRSHEGETSYIRVYPERSTSYGYSRSRSGSRGRDSPYQSRGSPHYFSPFRPY

SEQ ID NO: 77797 - protein, 109 aa, Homo sapiens
  Payload ID: 15507
  Gene Symbol: SRSF9
  Gene Name: serine/arginine-rich splicing factor 9
  ENSP ID: ENSP00000449030
  MOD_RES (1)..(1): Any amino acid
XGRIYVGNLPTDVREKDLEDLFYKYGRIREIELKNRHGLVPFAFVRFEDPRDAEDAIYGRNGLPPSGSWQDLKDHMREAGDVCYADVQKDGVGMVEYLRKEDMEYALRK

SEQ ID NO: 77798 - protein, 119 aa, Homo sapiens
  Payload ID: 15507
  Gene Symbol: SRSF9
  Gene Name: serine/arginine-rich splicing factor 9
  ENSP ID: ENSP00000474283
MSGWADERGGEGDGRIYVGNLPTDVREKDLEDLFYKYGRIREIELKNRHGLVPFAFVRFEDPRDAEDAIYGRNGYDYGQCRLRVEFPRTYGGRGGWPRGGRNGPPTRRSDFRVLVSENY

SEQ ID NO: 77799 - protein, 968 aa, Homo sapiens
  Payload ID: 15508
  Gene Symbol: STK10
  Gene Name: serine/threonine kinase 10
  Uniprot ID: O94804
  ENSP ID: ENSP00000176763
MAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQVAEQGGDLSPAANRSQKASQSRPNSSALETLGGEKLANGSLEPPAQAAPGPSKRDSDCSSLCTSESMDYGTNLSTDLSLNKEMGSLSIKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 77800 - protein, 281 aa, Homo sapiens
  Payload ID: 15508
  Gene Symbol: STK10
  Gene Name: serine/threonine kinase 10
  ENSP ID: ENSP00000428806
  MOD_RES (1)..(1): Any amino acid
XLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKMESRTVAQVGVQWRNLNSGSGRGSEPEEAGAGDVLQAERGGGVPKPLHPKQGRQVLPLQFCGCFLTTARGCGWQLGGPQGLLLHSL

SEQ ID NO: 77801 - protein, 433 aa, Homo sapiens
  Payload ID: 15509
  Gene Symbol: STK11
  Gene Name: serine/threonine kinase 11
  Uniprot ID: Q15831
  ENSP ID: ENSP00000324856
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 77802 - protein, 101 aa, Homo sapiens
  Payload ID: 15509
  Gene Symbol: STK11
  Gene Name: serine/threonine kinase 11
  ENSP ID: ENSP00000466610
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKNSWPL

SEQ ID NO: 77803 - protein, 432 aa, Homo sapiens
  Payload ID: 15509
  Gene Symbol: STK11
  Gene Name: serine/threonine kinase 11
  ENSP ID: ENSP00000467240
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEAGPPTLPARPAASSKIRRLSACKQQ

SEQ ID NO: 77804 - protein, 153 aa, Homo sapiens
  Payload ID: 15509
  Gene Symbol: STK11
  Gene Name: serine/threonine kinase 11
  ENSP ID: ENSP00000467912
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKYFCQLIDGLEYLHSQGIVHKDIKPGNLLLTTGGTLKISDLGVAEALHPFAADDTCR

SEQ ID NO: 77805 - protein, 21 aa, Homo sapiens
  Payload ID: 15509
  Gene Symbol: STK11
  Gene Name: serine/threonine kinase 11
  ENSP ID: ENSP00000477641
MYMVMEYCVCGMQEMLDSVPE

SEQ ID NO: 77806 - protein, 1099 aa, Homo sapiens
  Payload ID: 15510
  Gene Symbol: STK11IP
  Gene Name: serine/threonine kinase 11 interacting protein
  Uniprot ID: Q8N1F8
  ENSP ID: ENSP00000295641
RFGSAPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPSASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 77807 - protein, 1088 aa, Homo sapiens
  Payload ID: 15510
  Gene Symbol: STK11IP
  Gene Name: serine/threonine kinase 11 interacting protein
  ENSP ID: ENSP00000389383
MTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPSASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 77808 - protein, 110 aa, Homo sapiens
  Payload ID: 15510
  Gene Symbol: STK11IP
  Gene Name: serine/threonine kinase 11 interacting protein
  ENSP ID: ENSP00000394192
MTTAQRDSLLWKLAGLLRESGDVVLSGCSTLSLLTPTLQQLNHVFELHLGPWGPGQTGFVALPSHPADSPVILQLQFLFDVLQKTLSLKVLGVGKRQDVQGAQENDGSWG

SEQ ID NO: 77809 - protein, 199 aa, Homo sapiens
  Payload ID: 15510
  Gene Symbol: STK11IP
  Gene Name: serine/threonine kinase 11 interacting protein
  ENSP ID: ENSP00000403923
  MOD_RES (1)..(1): Any amino acid
XQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGEASVQLMLPWSLYPTLSQALAHAQHLYSALAATVSSWNLENLSLEGIAE

SEQ ID NO: 77810 - protein, 166 aa, Homo sapiens
  Payload ID: 15510
  Gene Symbol: STK11IP
  Gene Name: serine/threonine kinase 11 interacting protein
  ENSP ID: ENSP00000406371
  MOD_RES (1)..(1): Any amino acid
XEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVRKLRLGDVNQFAQSKVVEPGIESTVP

SEQ ID NO: 77811 - protein, 96 aa, Homo sapiens
  Payload ID: 15510
  Gene Symbol: STK11IP
  Gene Name: serine/threonine kinase 11 interacting protein
  ENSP ID: ENSP00000469777
  MOD_RES (1)..(1): Any amino acid
XICPDRQLRRYLVLEPDAHAAVQELLAVLTPVTNVAREQLGEARDLLLGRFQCLRCGHEFKPEEPRMGLDSEEGWRPLFQKTDQSALSLKKTLKKK

SEQ ID NO: 77812 - protein, 305 aa, Homo sapiens
  Payload ID: 15511
  Gene Symbol: STK16
  Gene Name: serine/threonine kinase 16
  Uniprot ID: O75716
  ENSP ID: ENSP00000379964
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 77813 - protein, 187 aa, Homo sapiens
  Payload ID: 15511
  Gene Symbol: STK16
  Gene Name: serine/threonine kinase 16
  ENSP ID: ENSP00000386309
MGHALCVCSRGTVIIDNKRYLFIQKLGEGDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 77814 - protein, 273 aa, Homo sapiens
  Payload ID: 15511
  Gene Symbol: STK16
  Gene Name: serine/threonine kinase 16
  ENSP ID: ENSP00000386553
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 77815 - protein, 305 aa, Homo sapiens; identical to SEQ ID NO: 77812
  Payload ID: 15511
  Gene Symbol: STK16
  Gene Name: serine/threonine kinase 16
  Uniprot ID: O75716
  ENSP ID: ENSP00000386928

SEQ ID NO: 77816 - protein, 350 aa, Homo sapiens
  Payload ID: 15511
  Gene Symbol: STK16
  Gene Name: serine/threonine kinase 16
  ENSP ID: ENSP00000387156
MGHALCVCSRGTVIIDNKRYLFIQKLGEGFLLEPHLGKVSAKWEGHPTPHQEISLGPSHVGDDHGPLLTPLAHSGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 77817 - protein, 414 aa, Homo sapiens
  Payload ID: 15512
  Gene Symbol: STK17A
  Gene Name: serine/threonine kinase 17a
  Uniprot ID: Q9UEE5
  ENSP ID: ENSP00000319192
MIPLEKPGSGGSSPGATSGSGRAGRGLSGPCRPPPPPQARGLLTEIRAVVRTEPFQDGYSLCPGRELGRGKFAVVRKCIKKDSGKEFAAKFMRKRRKGQDCRMEIIHEIAVLELAQDNPWVINLHEVYETASEMILVLEYAAGGEIFDQCVADREEAFKEKDVQRLMRQILEGVHFLHTRDVVHLDLKPQNILLTSESPLGDIKIVDFGLSRILKNSEELREIMGTPEYVAPEILSYDPISMATDMWSIGVLTYVMLTGISPFLGNDKQETFLNISQMNLSYSEEEFDVLSESAVDFIRTLLVKKPEDRATAEECLKHPWLTQSSIQEPSFRMEKALEEANALQEGHSVPEINSDTDKSETKESIVTEELIVVTSYTLGQCRQSEKEKMEQKAISKRFKFEEPLLQEIPGEFIY

SEQ ID NO: 77818 - protein, 372 aa, Homo sapiens
  Payload ID: 15513
  Gene Symbol: STK17B
  Gene Name: serine/threonine kinase 17b
  Uniprot ID: O94768
  ENSP ID: ENSP00000263955
MSRRRFDCRSISGLLTTTPQIPIKMENFNNFYILTSKELGRGKFAVVRQCISKSTGQEYAAKFLKKRRRGQDCRAEILHEIAVLELAKSCPRVINLHEVYENTSEIILILEYAAGGEIFSLCLPELAEMVSENDVIRLIKQILEGVYYLHQNNIVHLDLKPQNILLSSIYPLGDIKIVDFGMSRKIGHACELREIMGTPEYLAPEILNYDPITTATDMWNIGIIAYMLLTHTSPFVGEDNQETYLNISQVNVDYSEETFSSVSQLATDFIQSLLVKNPEKRPTAEICLSHSWLQQWDFENLFHPEETSSSSQTQDHSVRSSEDKTSKSSCNGTCGDREDKENIPEDSSMVSKRFRFDDSLPNPHELVSDLLC

SEQ ID NO: 77819 - protein, 372 aa, Homo sapiens; identical to SEQ ID NO: 77818
  Payload ID: 15513
  Gene Symbol: STK17B
  Gene Name: serine/threonine kinase 17b
  Uniprot ID: O94768
  ENSP ID: ENSP00000386853

SEQ ID NO: 77820 - protein, 67 aa, Homo sapiens
  Payload ID: 15513
  Gene Symbol: STK17B
  Gene Name: serine/threonine kinase 17b
  ENSP ID: ENSP00000399755
MSRRRFDCRSISGLLTTTPQIPIKMENFNNFYILTSKELGRGKFAVVRQCISKSTGQEYAAKFLKKR

SEQ ID NO: 77821 - protein, 6 aa, Homo sapiens
  Payload ID: 15513
  Gene Symbol: STK17B
  Gene Name: serine/threonine kinase 17b
  ENSP ID: ENSP00000413289
MSRRRF

SEQ ID NO: 77822 - protein, 69 aa, Homo sapiens
  Payload ID: 15513
  Gene Symbol: STK17B
  Gene Name: serine/threonine kinase 17b
  ENSP ID: ENSP00000475843
KFAVVRQCISKSTGQEYAAKFLKKRRRGQDCRAEILHEIAVLELAKSCPRVINLHEVYENTSEIILILE

SEQ ID NO: 77823 - protein, 364 aa, Homo sapiens
  Payload ID: 15514
  Gene Symbol: STK19
  Gene Name: serine/threonine kinase 19
  Uniprot ID: P49842
  ENSP ID: ENSP00000364480
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 77824 - protein, 368 aa, Homo sapiens
  Payload ID: 15514
  Gene Symbol: STK19
  Gene Name: serine/threonine kinase 19
  Uniprot ID: P49842
  ENSP ID: ENSP00000364482
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVCDCVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 77825 - protein, 368 aa, Homo sapiens [sequence omitted]

SEQ ID NO: 77826 - protein, 364 aa, Homo sapiens
  Payload ID: 15514
  Gene Symbol: STK19
  Gene Name: serine/threonine kinase 19
  ENSP ID: ENSP00000372818
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLGMVRKAKYRELLLSELLGRRAPVVVRLGLTYHVHDLIGAQLVDCISTTSGTLLRLPET

SEQ ID NO: 77827 - protein, 364 aa, Homo sapiens; identical to SEQ ID NO: 77823
  Payload ID: 15514
  Gene Symbol: STK19
  Gene Name: serine/threonine kinase 19
  Uniprot ID: P49842
  ENSP ID: ENSP00000389352

SEQ ID NO: 77828 - protein, 368 aa, Homo sapiens; identical to SEQ ID NO: 77824
  Payload ID: 15514
  Gene Symbol: STK19
  Gene Name: serine/threonine kinase 19
  Uniprot ID: P49842
  ENSP ID: ENSP00000391798

SEQ ID NO: 77829 - protein, 364 aa, Homo sapiens; identical to SEQ ID NO: 77823
  Payload ID: 15514
  Gene Symbol: STK19
  Gene Name: serine/threonine kinase 19
  Uniprot ID: P49842
  ENSP ID: ENSP00000393272

SEQ ID NO: 77830 - protein, 364 aa, Homo sapiens; identical to SEQ ID NO: 77823
  Payload ID: 15514
  Gene Symbol: STK19
  Gene Name: serine/threonine kinase 19
  Uniprot ID: P49842
  ENSP ID: ENSP00000395028

SEQ ID NO: 77831 - protein, 368 aa, Homo sapiens; identical to SEQ ID NO: 77824
  Payload ID: 15514
  Gene Symbol: STK19
  Gene Name: serine/threonine kinase 19
  Uniprot ID: P49842
  ENSP ID: ENSP00000395864

SEQ ID NO: 77832 - protein, 364 aa, Homo sapiens; identical to SEQ ID NO: 77823
  Payload ID: 15514
  Gene Symbol: STK19
  Gene Name: serine/threonine kinase 19
  Uniprot ID: P49842
  ENSP ID: ENSP00000399915

SEQ ID NO: 77833 - protein, 368 aa, Homo sapiens; identical to SEQ ID NO: 77824
  Payload ID: 15514
  Gene Symbol: STK19
  Gene Name: serine/threonine kinase 19
  Uniprot ID: P49842
  ENSP ID: ENSP00000403479

SEQ ID NO: 77834 - protein, 368 aa, Homo sapiens; identical to SEQ ID NO: 77824
  Payload ID: 15514
  Gene Symbol: STK19
  Gene Name: serine/threonine kinase 19
  Uniprot ID: P49842
  ENSP ID: ENSP00000413766

SEQ ID NO: 77835 - protein, 112 aa, Homo sapiens
  Payload ID: 15514
  Gene Symbol: STK19
  Gene Name: serine/threonine kinase 19
  ENSP ID: ENSP00000418350
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMS

SEQ ID NO: 77836 - protein, 70 aa, Homo sapiens; identical to SEQ ID NO: 22459
  Payload ID: 15514
  Gene Symbol: STK19
  Gene Name: serine/threonine kinase 19
  ENSP ID: ENSP00000418866
  MOD_RES (1)..(1): Any amino acid

SEQ ID NO: 77837 - protein, 70 aa, Homo sapiens; identical to SEQ ID NO: 22459
  Payload ID: 15514
  Gene Symbol: STK19
  Gene Name: serine/threonine kinase 19
  ENSP ID: ENSP00000428007
  MOD_RES (1)..(1): Any amino acid

SEQ ID NO: 77838 - protein, 70 aa, Homo sapiens; identical to SEQ ID NO: 22459
  Payload ID: 15514
  Gene Symbol: STK19
  Gene Name: serine/threonine kinase 19
  ENSP ID: ENSP00000429285
  MOD_RES (1)..(1): Any amino acid

SEQ ID NO: 77839 - protein, 321 aa, Homo sapiens
  Payload ID: 15514
  Gene Symbol: STK19
  Gene Name: serine/threonine kinase 19
  ENSP ID: ENSP00000446620
MLVCASPPPLPALTGLRDDKLTLLSSSPGLGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 77840 - protein, 321 aa, Homo sapiens; identical to SEQ ID NO: 77839
  Payload ID: 15514
  Gene Symbol: STK19
  Gene Name: serine/threonine kinase 19
  ENSP ID: ENSP00000446725

SEQ ID NO: 77841 - protein, 321 aa, Homo sapiens; identical to SEQ ID NO: 77839
  Payload ID: 15514
  Gene Symbol: STK19
  Gene Name: serine/threonine kinase 19
  ENSP ID: ENSP00000447097

SEQ ID NO: 77842 - protein, 321 aa, Homo sapiens
  Payload ID: 15514
  Gene Symbol: STK19
  Gene Name: serine/threonine kinase 19
  ENSP ID: ENSP00000448123
MLVCASPPPLPALTGLRDDKLTLLSSSPGLGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLGMVRKAKYRELLLSELLGRRAPVVVRLGLTYHVHDLIGAQLVDCISTTSGTLLRLPET

SEQ ID NO: 77843 - protein, 321 aa, Homo sapiens; identical to SEQ ID NO: 77839
  Payload ID: 15514
  Gene Symbol: STK19
  Gene Name: serine/threonine kinase 19
  ENSP ID: ENSP00000449149

SEQ ID NO: 77844 - protein, 70 aa, Homo sapiens; identical to SEQ ID NO: 22459
  Payload ID: 15514
  Gene Symbol: STK19
  Gene Name: serine/threonine kinase 19
  ENSP ID: ENSP00000454870
  MOD_RES (1)..(1): Any amino acid

SEQ ID NO: 77845 - protein, 67 aa, Homo sapiens
  Payload ID: 15514
  Gene Symbol: STK19
  Gene Name: serine/threonine kinase 19
  ENSP ID: ENSP00000476036
PGTIKSRDMSWKRHHLIPETFGVKRRRKRGPVESDPLRGEPEGASRAGGDQNRPAGLRLGCPWNYLH

SEQ ID NO: 77846 - protein, 443 aa, Homo sapiens
  Payload ID: 15515
  Gene Symbol: STK24
  Gene Name: serine/threonine kinase 24
  Uniprot ID: Q9Y6E0
  ENSP ID: ENSP00000365730
MDSRAQLWGLALNKRRATLPHPGGSTNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 77847 - protein, 209 aa, Homo sapiens
  Payload ID: 15515
  Gene Symbol: STK24
  Gene Name: serine/threonine kinase 24
  ENSP ID: ENSP00000365737
ADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKLKEKSQACGGNLGSIEELRGAIYLAEEACPGISDTMVAQLVQRLQRYSLSGGGTSSH

SEQ ID NO: 77848 - protein, 412 aa, Homo sapiens
  Payload ID: 15515
  Gene Symbol: STK24
  Gene Name: serine/threonine kinase 24
  ENSP ID: ENSP00000380651
MAHSPVQSGLPGMQNLKADPEELFTKLEKIGKGSFGEVFKGIDNRTQKVVAIKIIDLEEAEDEIEDIQQEITVLSQCDSPYVTKYYGSYLKLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 77849 - protein, 369 aa, Homo sapiens
  Payload ID: 15515
  Gene Symbol: STK24
  Gene Name: serine/threonine kinase 24
  ENSP ID: ENSP00000402764
  MOD_RES (1)..(1): Any amino acid
XKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRSIHGNQAPPDCHLAQVQAFGGSGCVLGSRSV

SEQ ID NO: 77850 - protein, 142 aa, Homo sapiens
  Payload ID: 15515
  Gene Symbol: STK24
  Gene Name: serine/threonine kinase 24
  ENSP ID: ENSP00000402810
KKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQR

SEQ ID NO: 77851 - protein, 431 aa, Homo sapiens
  Payload ID: 15515
  Gene Symbol: STK24
  Gene Name: serine/threonine kinase 24
  Uniprot ID: Q9Y6E0
  ENSP ID: ENSP00000442539
MAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 77852 - protein, 426 aa, Homo sapiens
  Payload ID: 15516
  Gene Symbol: STK25
  Gene Name: serine/threonine kinase 25
  Uniprot ID: O00506
  ENSP ID: ENSP00000325748
MAHLRGFANQHSRVDPEELFTKLDRIGKGSFGEVYKGIDNHTKEVVAIKIIDLEEAEDEIEDIQQEITVLSQCDSPYITRYFGSYLKSTKLWIIMEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDIDGEAEDGEQGPIWTFPPTIRPSPHSKLHKGTALHSSQKPAEPVKRQPRSQCLSTLVRPVFGELKEKHKQSGGSVGALEELENAFSLAEESCPGISDKLMVHLVERVQRFSHNRNHLTSTR

SEQ ID NO: 77853 - protein, 426 aa, Homo sapiens; identical to SEQ ID NO: 77852
  Payload ID: 15516
  Gene Symbol: STK25
  Gene Name: serine/threonine kinase 25
  Uniprot ID: O00506
  ENSP ID: ENSP00000384162

SEQ ID NO: 77854 - protein, 349 aa, Homo sapiens
  Payload ID: 15516
  Gene Symbol: STK25
  Gene Name: serine/threonine kinase 25
  Uniprot ID: O00506
  ENSP ID: ENSP00000384444
MAHLRGFANQSTKLWIIMEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDIDGEAEDGEQGPIWTFPPTIRPSPHSKLHKGTALHSSQKPAEPVKRQPRSQCLSTLVRPVFGELKEKHKQSGGSVGALEELENAFSLAEESCPGISDKLMVHLVERVQRFSHNRNHLTSTR

SEQ ID NO: 77855 - protein, 349 aa, Homo sapiens; identical to SEQ ID NO: 77854
  Payload ID: 15516
  Gene Symbol: STK25
  Gene Name: serine/threonine kinase 25
  Uniprot ID: O00506
  ENSP ID: ENSP00000385541

SEQ ID NO: 77856 - protein, 426 aa, Homo sapiens; identical to SEQ ID NO: 77852
  Payload ID: 15516
  Gene Symbol: STK25
  Gene Name: serine/threonine kinase 25
  Uniprot ID: O00506
  ENSP ID: ENSP00000385687

SEQ ID NO: 77857 - protein, 148 aa, Homo sapiens
  Payload ID: 15516
  Gene Symbol: STK25
  Gene Name: serine/threonine kinase 25
  ENSP ID: ENSP00000395104
MEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKP

SEQ ID NO: 77858 - protein, 177 aa, Homo sapiens
  Payload ID: 15516
  Gene Symbol: STK25
  Gene Name: serine/threonine kinase 25
  ENSP ID: ENSP00000399212
MEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFIT

SEQ ID NO: 77859 - protein, 48 aa, Homo sapiens
  Payload ID: 15516
  Gene Symbol: STK25
  Gene Name: serine/threonine kinase 25
  ENSP ID: ENSP00000401114
MEYLGGGSALDLLKPGPLEETYIATILREILKGLDYLHSERKIHRDIK

SEQ ID NO: 77860 - protein, 163 aa, Homo sapiens
  Payload ID: 15516
  Gene Symbol: STK25
  Gene Name: serine/threonine kinase 25
  ENSP ID: ENSP00000403607
MEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRF

SEQ ID NO: 77861 - protein, 58 aa, Homo sapiens
  Payload ID: 15516
  Gene Symbol: STK25
  Gene Name: serine/threonine kinase 25
  ENSP ID: ENSP00000403866
MEYLGGGSALDLLKPGPLEETYIATILREILKGLDYLHSERKIHRDIKGPAGGGCGSC

SEQ ID NO: 77862 - protein, 247 aa, Homo sapiens
  Payload ID: 15516
  Gene Symbol: STK25
  Gene Name: serine/threonine kinase 25
  ENSP ID: ENSP00000404469
  MOD_RES (1)..(1): Any amino acid
XILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDILRSPSRGSRGPSACPRWSGPSSESSKRSTSRAAGAWVRWRSWRTPSAWPRSPAPASQTS

SEQ ID NO: 77863 - protein, 89 aa, Homo sapiens
  Payload ID: 15516
  Gene Symbol: STK25
  Gene Name: serine/threonine kinase 25
  ENSP ID: ENSP00000404552
MEPRGEFQSPRGLALKKGCAAACFKHSRVDPEELFTKLDRIGKGSFGEVYKGIDNHTKEVVAIKIIDLEEAEDEIEDIQQEITVLSQCD

SEQ ID NO: 77864 - protein, 79 aa, Homo sapiens
  Payload ID: 15516
  Gene Symbol: STK25
  Gene Name: serine/threonine kinase 25
  ENSP ID: ENSP00000404960
MEYLGGGSALDLLKPGPLEETYIATILREILKGLDYLHSERKIHRDIKAANVLLSEQGDVKLADFGVAGQLTDTQIKRN

SEQ ID NO: 77865 - protein, 19 aa, Homo sapiens
  Payload ID: 15516
  Gene Symbol: STK25
  Gene Name: serine/threonine kinase 25
  ENSP ID: ENSP00000406208
MEYLGGGSALDLLKPGPLE

SEQ ID NO: 77866 - protein, 151 aa, Homo sapiens
  Payload ID: 15516
  Gene Symbol: STK25
  Gene Name: serine/threonine kinase 25
  ENSP ID: ENSP00000412617
MAHLRGFANQHSRVDPEELFTKLDRIGKGSFGEVYKGIDNHTKEVVAIKIIDLEEAEDEIEDIQQEITVLSQCDSPYITRYFGSYLKSTKLWIIMEYLGGGSALDLLKPGPLEETYIATILREILKGLDYLHSERKIHRDIKAANVLLSEQ

SEQ ID NO: 77867 - protein, 115 aa, Homo sapiens
  Payload ID: 15516
  Gene Symbol: STK25
  Gene Name: serine/threonine kinase 25
  ENSP ID: ENSP00000414191
MAHLRGFANQHSRVDPEELFTKLDRIGKGSFGEVYKGIDNHTKEVVAIKIIDLEEAEDEIEDIQQEITVLSQCDSPYITRYFGSYLKVPVVGRRGPCWCCARLSSMSEGLSDMPE

SEQ ID NO: 77868 - protein, 161 aa, Homo sapiens
  Payload ID: 15516
  Gene Symbol: STK25
  Gene Name: serine/threonine kinase 25
  ENSP ID: ENSP00000417020
MAHLRGFANQLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRF

SEQ ID NO: 77869 - protein, 332 aa, Homo sapiens
  Payload ID: 15516
  Gene Symbol: STK25
  Gene Name: serine/threonine kinase 25
  Uniprot ID: O00506
  ENSP ID: ENSP00000444886
MEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDIDGEAEDGEQGPIWTFPPTIRPSPHSKLHKGTALHSSQKPAEPVKRQPRSQCLSTLVRPVFGELKEKHKQSGGSVGALEELENAFSLAEESCPGISDKLMVHLVERVQRFSHNRNHLTSTR

SEQ ID NO: 77870 - protein, 332 aa, Homo sapiens; identical to SEQ ID NO: 77869
  Payload ID: 15516
  Gene Symbol: STK25
  Gene Name: serine/threonine kinase 25
  Uniprot ID: O00506
  ENSP ID: ENSP00000446008

SEQ ID NO: 77871 - protein, 491 aa, Homo sapiens
  Payload ID: 15517
  Gene Symbol: STK3
  Gene Name: serine/threonine kinase 3
  Uniprot ID: Q13188
  ENSP ID: ENSP00000390500
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 77872 - protein, 228 aa, Homo sapiens
  Payload ID: 15517
  Gene Symbol: STK3
  Gene Name: serine/threonine kinase 3
  ENSP ID: ENSP00000428014
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRA

SEQ ID NO: 77873 - protein, 168 aa, Homo sapiens
  Payload ID: 15517
  Gene Symbol: STK3
  Gene Name: serine/threonine kinase 3
  ENSP ID: ENSP00000428167
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTGFLTDTTEGSASCDLRMDLTLFHLGAEFLHYLLLYEADPLSCVFSLLVFSV

SEQ ID NO: 77874 - protein, 1 aa, Homo sapiens
  Payload ID: 15517
  Gene Symbol: STK3
  Gene Name: serine/threonine kinase 3
  ENSP ID: ENSP00000428295
M

SEQ ID NO: 77875 - protein, 82 aa, Homo sapiens
  Payload ID: 15517
  Gene Symbol: STK3
  Gene Name: serine/threonine kinase 3
  ENSP ID: ENSP00000429369
MEQPPAPKSKLKKLSEDSLTKQPEEVFDVLEKLGEGSYGSVFKAIHKESGQVVAIKQVPVESDLQEIIKEISIMQQCDRLFL

SEQ ID NO: 77876 - protein, 519 aa, Homo sapiens
  Payload ID: 15517
  Gene Symbol: STK3
  Gene Name: serine/threonine kinase 3
  Uniprot ID: Q13188
  ENSP ID: ENSP00000429744
MLQLMDSGITICLRNGAASVFKKKEWSTQGEENKQDSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 77877 - protein, 380 aa, Homo sapiens
  Payload ID: 15517
  Gene Symbol: STK3
  Gene Name: serine/threonine kinase 3
  ENSP ID: ENSP00000482260
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 77878 - protein, 996 aa, Homo sapiens
  Payload ID: 15518
  Gene Symbol: STK31
  Gene Name: serine/threonine kinase 31
  Uniprot ID: Q9BXU1
  ENSP ID: ENSP00000346660
MDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 77879 - protein, 1019 aa, Homo sapiens
  Payload ID: 15518
  Gene Symbol: STK31
  Gene Name: serine/threonine kinase 31
  Uniprot ID: Q9BXU1
  ENSP ID: ENSP00000348132
MWVQGHSSRASATESVSFSGIVQMDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 77880 - protein, 159 aa, Homo sapiens
  Payload ID: 15518
  Gene Symbol: STK31
  Gene Name: serine/threonine kinase 31
  ENSP ID: ENSP00000389340
MDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKAT

SEQ ID NO: 77881 - protein, 93 aa, Homo sapiens
  Payload ID: 15518
  Gene Symbol: STK31
  Gene Name: serine/threonine kinase 31
  ENSP ID: ENSP00000398413
MDEDTHYDKVEDVVGSHIEDAVTFWAQSINRNKDIMKIGCSLSEVCPQASSVLGNLDPNKIYGGLFSEDQCWYRCKVLKIISVEKCLVRYIDY

SEQ ID NO: 77882 - protein, 996 aa, Homo sapiens
  Payload ID: 15518
  Gene Symbol: STK31
  Gene Name: serine/threonine kinase 31
  Uniprot ID: Q9BXU1
  ENSP ID: ENSP00000411852
MWVQGHSSRASATESVSFSGIVQMDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWDDKVKSLLCSLICYRSSMTAEQVLNAECFLMPKEQSVPNPEKDTEYTLYKKEEEIKTENLDKCMEKTRNGEANFDC

SEQ ID NO: 77883 - protein, 140 aa, Homo sapiens
  Payload ID: 15518
  Gene Symbol: STK31
  Gene Name: serine/threonine kinase 31
  ENSP ID: ENSP00000414087
MDEDTHYDKVEDVVGSHIEDAVTFWAQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSE

SEQ ID NO: 77884 - protein, 42 aa, Homo sapiens
  Payload ID: 15518
  Gene Symbol: STK31
  Gene Name: serine/threonine kinase 31
  ENSP ID: ENSP00000435974
MDEDTHYDKVEDVVGSHIEDAVTFWAQSINRNKDIMKIGCSL

SEQ ID NO: 77885 - protein, 396 aa, Homo sapiens
  Payload ID: 15519
  Gene Symbol: STK32A
  Gene Name: serine/threonine kinase 32A
  Uniprot ID: Q8WU08
  ENSP ID: ENSP00000381030
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHGHVHITDFNIAAMLPRETQITTMAGTKPYMAPEMFSSRKGAGYSFAVDWWSLGVTAYELLRGRRPYHIRSSTSSKEIVHTFETTVVTYPSAWSQEMVSLLKKLLEPNPDQRFSQLSDVQNFPYMNDINWDAVFQKRLIPGFIPNKGRLNCDPTFELEEMILESKPLHKKKKRLAKKEKDMRKCDSSQTCLLQEHLDSVQKEFIIFNREKVNRDFNKRQPNLALEQTKDPQGEDGQNNNL

SEQ ID NO: 77886 - protein, 407 aa, Homo sapiens
  Payload ID: 15519
  Gene Symbol: STK32A
  Gene Name: serine/threonine kinase 32A
  ENSP ID: ENSP00000381535
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHGHVHITDFNIAAMLPRETQITTMAGTKPYMAPEMFSSRKGAGYSFAVDWWSLGVTAYELLRGRRPYHIRSSTSSKEIVHTFETTVVTYPSAWSQEMVSLLKKLLEPNPDQRFSQLSDVQNFPYMNDINWDAVFQKRLIPGFIPNKGRLNCDPTFELEEMILESKPLHKKKKRLAKKEKDMRKCDSSQTCLLQEHLDSVQKEFIIFNREKVNRDFNKRQPNLALEQTKDPQVTNGQMDTGLSETFQTSKVS

SEQ ID NO: 77887 - protein, 166 aa, Homo sapiens
  Payload ID: 15519
  Gene Symbol: STK32A
  Gene Name: serine/threonine kinase 32A
  Uniprot ID: Q8WU08
  ENSP ID: ENSP00000487441
MGANTSRKPPVFDENEDVNFDHFEILRAIGKGSFGKVCIVQKNDTKKMYAMKYMNKQKCVERNEVRNVFKELQIMQGLEHPFLVNLWYSFQDEEDMFMVVDLLLGGDLRYHLQQNVHFKEETVKLFICELVMALDYLQNQRIIHRDMKPDNILLDEHDTWLSYKSH

SEQ ID NO: 77888 - protein, 414 aa, Homo sapiens
  Payload ID: 15520
  Gene Symbol: STK32B
  Gene Name: serine/threonine kinase 32B
  Uniprot ID: Q9NY57
  ENSP ID: ENSP00000282908
MGGNHSHKPPVFDENEEVNFDHFQILRAIGKGSFGKVCIVQKRDTKKMYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 77889 - protein, 367 aa, Homo sapiens
  Payload ID: 15520
  Gene Symbol: STK32B
  Gene Name: serine/threonine kinase 32B
  Uniprot ID: Q9NY57
  ENSP ID: ENSP00000420984
MYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 77890 - protein, 51 aa, Homo sapiens
  Payload ID: 15520
  Gene Symbol: STK32B
  Gene Name: serine/threonine kinase 32B
  ENSP ID: ENSP00000422820
MGGNHSHKPPVFDENEEVNFDHFQILRAIGKGSFGKDCQCRLFLENLSEES

SEQ ID NO: 77891 - protein, 337 aa, Homo sapiens
  Payload ID: 15520
  Gene Symbol: STK32B
  Gene Name: serine/threonine kinase 32B
  ENSP ID: ENSP00000423209
MYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 77892 - protein, 486 aa, Homo sapiens
  Payload ID: 15521
  Gene Symbol: STK32C
  Gene Name: serine/threonine kinase 32C
  Uniprot ID: Q86UX6
  ENSP ID: ENSP00000298630
MRSGAERRGSSAAASPGSPPPGRARPAGSDAPSALPPPAAGQPRARDSGDVRSQPRPLFQWSKWKKRMGSSMSAATARRPVFDDKEDVNFDHFQILRAIGKGSFGKVCIVQKRDTEKMYAMKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPICPSAGSG

SEQ ID NO: 77893 - protein, 146 aa, Homo sapiens
  Payload ID: 15521
  Gene Symbol: STK32C
  Gene Name: serine/threonine kinase 32C
  ENSP ID: ENSP00000357608
MLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRSLLRAHPRTGILPGRCGMVWKDKKLQPSGCHEKAGGVFCGPSRGGV

SEQ ID NO: 77894 - protein, 239 aa, Homo sapiens
  Payload ID: 15521
  Gene Symbol: STK32C
  Gene Name: serine/threonine kinase 32C
  ENSP ID: ENSP00000357609
MLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRMNFDHFQILRAIGKGSFGKVSPRVPRRPQASCRTALCPPGVHCAEAGHGEDVRHEVHEQAAVHRARRGPQRLPGAGDPAGDRARLPGEPLVLLPGRGGHVHGRGPATGRGPALPPAAERAVLRGHGEAVHLRDGTGSGL

SEQ ID NO: 77895 - protein, 369 aa, Homo sapiens
  Payload ID: 15521
  Gene Symbol: STK32C
  Gene Name: serine/threonine kinase 32C
  Uniprot ID: Q86UX6
  ENSP ID: ENSP00000357611
MYAMKYMNKQQCIERDEVRNVFRELEILQEIEHVFLVNLWYSFQDEEDMFMVVDLLLGGDLRYHLQQNVQFSEDTVRLYICEMALALDYLRGQHIIHRDVKPDNILLDERGHAHLTDFNIATIIKDGERATALAGTKPYMAPEIFHSFVNGGTGYSFEVDWWSVGVMAYELLRGWRPYDIHSSNAVESLVQLFSTVSVQYVPTWSKEMVALLRKLLTVNPEHRLSSLQDVQAAPALAGVLWDHLSEKRVEPGFVPNKGRLHCDPTFELEEMILESRPLHKKKKRLAKNKSRDNSRDSSQSENDYLQDCLDAIQQDFVIFNREKLKRSQDLPREPLPAPESRDAAEPVEDEAERSALPMCGPICPSAGSG

SEQ ID NO: 77896 - protein, 102 aa, Homo sapiens
  Payload ID: 15521
  Gene Symbol: STK32C
  Gene Name: serine/threonine kinase 32C
  ENSP ID: ENSP00000389112
MLSAVWGAGGPGAGGAARGQPSRKELLLRHHLWSGPRCLSFPLGSLPASLLGLPGATSHRSCLSPNLASGLAARGTQTQSVLFGEVRLPLDGGVRGARKRRS

SEQ ID NO: 77897 - protein, 514 aa, Homo sapiens
  Payload ID: 15522
  Gene Symbol: STK33
  Gene Name: serine/threonine kinase 33
  Uniprot ID: Q9BYT3
  ENSP ID: ENSP00000320754
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 77898 - protein, 327 aa, Homo sapiens
  Payload ID: 15522
  Gene Symbol: STK33
  Gene Name: serine/threonine kinase 33
  ENSP ID: ENSP00000351743
MYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 77899 - protein, 514 aa, Homo sapiens; identical to SEQ ID NO: 77897
  Payload ID: 15522
  Gene Symbol: STK33
  Gene Name: serine/threonine kinase 33
  Uniprot ID: Q9BYT3
  ENSP ID: ENSP00000379905

SEQ ID NO: 77900 - protein, 215 aa, Homo sapiens
  Payload ID: 15522
  Gene Symbol: STK33
  Gene Name: serine/threonine kinase 33
  ENSP ID: ENSP00000391362
MSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNE

SEQ ID NO: 77901 - protein, 63 aa, Homo sapiens
  Payload ID: 15522
  Gene Symbol: STK33
  Gene Name: serine/threonine kinase 33
  ENSP ID: ENSP00000397569
MADSGLDKKSTKCPDCSSASQKDVLCVCSSKTRVPPVLVVEMSQTSSIGSAESLISLERKKEK

SEQ ID NO: 77902 - protein, 37 aa, Homo sapiens
  Payload ID: 15522
  Gene Symbol: STK33
  Gene Name: serine/threonine kinase 33
  ENSP ID: ENSP00000397874
MADSGLDKKSTKCPDCSSASQKDVLCVCSSKTRVPPV

SEQ ID NO: 77903 - protein, 171 aa, Homo sapiens
  Payload ID: 15522
  Gene Symbol: STK33
  Gene Name: serine/threonine kinase 33
  ENSP ID: ENSP00000403599
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVK

SEQ ID NO: 77904 - protein, 191 aa, Homo sapiens
  Payload ID: 15522
  Gene Symbol: STK33
  Gene Name: serine/threonine kinase 33
  ENSP ID: ENSP00000411510
MSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNN

SEQ ID NO: 77905 - protein, 203 aa, Homo sapiens
  Payload ID: 15522
  Gene Symbol: STK33
  Gene Name: serine/threonine kinase 33
  ENSP ID: ENSP00000415688
VKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTSTAYEKQFPATSKDNFDMCSSSFTSSKLLPAEIKGEMEKTPVTPSQGTATKYPAKSGALSRTKKKL

SEQ ID NO: 77906 - protein, 514 aa, Homo sapiens; identical to SEQ ID NO: 77897
  Payload ID: 15522
  Gene Symbol: STK33
  Gene Name: serine/threonine kinase 33
  Uniprot ID: Q9BYT3
  ENSP ID: ENSP00000416750

SEQ ID NO: 77907 - protein, 29 aa, Homo sapiens
  Payload ID: 15522
  Gene Symbol: STK33
  Gene Name: serine/threonine kinase 33
  ENSP ID: ENSP00000432822
MADSGLDKKSTKCPDCSSASQKDVLCVCS

SEQ ID NO: 77908 - protein, 473 aa, Homo sapiens
  Payload ID: 15522
  Gene Symbol: STK33
  Gene Name: serine/threonine kinase 33
  ENSP ID: ENSP00000436418
MSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 77909 - protein, 211 aa, Homo sapiens
  Payload ID: 15522
  Gene Symbol: STK33
  Gene Name: serine/threonine kinase 33
  ENSP ID: ENSP00000436905
AESLISLERKKEKNINRDITSRKDLPSRTSNVERKASQQQWGRGNFTEGKVPHIRIENGAAIEAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHD

SEQ ID NO: 77910 - protein, 534 aa, Homo sapiens [sequence omitted]

SEQ ID NO: 77911 - protein, 395 aa, Homo sapiens
  Payload ID: 15523
  Gene Symbol: STK35
  Gene Name: serine/threonine kinase 35
  ENSP ID: ENSP00000426612
GARRGTQSPERKRRSPVPRAPSTKLRPAAAARAMDPVAAEAPGEAFLARRRPEGGGGSARPRYSLLAEIGRGSYGVVYEAVAGRSGARVAVKKIRCDAPENVELALAEFWALTSLKRRHQNVVQFEECVLQRNGLAQRMSHGNKSSQLYLRLVETSLKGERILGYAEEPCYLWFVMEFCEGGDLNQYVLSRRPDPATNKSFMLQLTSAIAFLHKNHIVHRDLKPDNILITERSGTPILKVADFGLSKVCAGLAPRGKEGNQDNKNVNVNKYWLSSACGSDFYMAPEVWEGHYTAKADIFALGIIIWAMIERITFIDSETKKELLGTYIKQGTEIVPVGEALLENPKMELHIPQKRRTSMSEGIKQLLKDMLAANPQDRPDAFELETRMDQVTCAA

SEQ ID NO: 77912 - protein, 1315 aa, Homo sapiens
  Payload ID: 15524
  Gene Symbol: STK36
  Gene Name: serine/threonine kinase 36
  Uniprot ID: Q9NRP7
  ENSP ID: ENSP00000295709
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEVRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 77913 - protein, 1294 aa, Homo sapiens
  Payload ID: 15524
  Gene Symbol: STK36
  Gene Name: serine/threonine kinase 36
  Uniprot ID: Q9NRP7
  ENSP ID: ENSP00000375954
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAELLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 77914 - protein, 1315 aa, Homo sapiens; identical to SEQ ID NO: 77912
  Payload ID: 15524
  Gene Symbol: STK36
  Gene Name: serine/threonine kinase 36
  Uniprot ID: Q9NRP7
  ENSP ID: ENSP00000394095

SEQ ID NO: 77915 - protein, 75 aa, Homo sapiens
  Payload ID: 15524
  Gene Symbol: STK36
  Gene Name: serine/threonine kinase 36
  ENSP ID: ENSP00000400055
MRGLRHPNIVHMLDSFETDKEVVVVTDYAEGELFQILEDDGKLPEDQVQAIAAQLVSALYYLHSHRILHRDMKPQ

SEQ ID NO: 77916 - protein, 278 aa, Homo sapiens
  Payload ID: 15524
  Gene Symbol: STK36
  Gene Name: serine/threonine kinase 36
  ENSP ID: ENSP00000403527
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLP

SEQ ID NO: 77917 - protein, 148 aa, Homo sapiens
  Payload ID: 15524
  Gene Symbol: STK36
  Gene Name: serine/threonine kinase 36
  ENSP ID: ENSP00000404719
  MOD_RES (1)..(1): Any amino acid
XRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQASFASPLRWTWMLTSL

SEQ ID NO: 77918 - protein, 106 aa, Homo sapiens
  Payload ID: 15524
  Gene Symbol: STK36
  Gene Name: serine/threonine kinase 36
  ENSP ID: ENSP00000406184
  MOD_RES (1)..(1): Any amino acid
XGTGEVPSAPRENRTTPDCERAFPEERPEVLGQRSTDVVDLENEEPDSDNEWQHLLETTEPVPIQLKAPLTLLCNPDFCQRIQSQLHEAGGQVKGWRREGADGNGT

SEQ ID NO: 77919 - protein, 66 aa, Homo sapiens
  Payload ID: 15524
  Gene Symbol: STK36
  Gene Name: serine/threonine kinase 36
  ENSP ID: ENSP00000409688
  MOD_RES (1)..(1): Any amino acid
XENEEPDSDNEWQHLLETTEPVPIQLKAPLTLLCNPDFCQRIQSQLHEAGGQVKGWRREGADGNGT

SEQ ID NO: 77920 - protein, 465 aa, Homo sapiens
  Payload ID: 15525
  Gene Symbol: STK38
  Gene Name: serine/threonine kinase 38
  Uniprot ID: Q15208
  ENSP ID: ENSP00000229812
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPISEKAKDLILRFCCEWEHRIGAPGVEEIKSNSFFEGVDWEHIRERPAAISIEIKSIDDTSNFDEFPESDILKPTVATSNHPETDYKNKDWVFINYTYKRFEGLTARGAIPSYMKAAK

SEQ ID NO: 77921 - protein, 464 aa, Homo sapiens
  Payload ID: 15526
  Gene Symbol: STK38L
  Gene Name: serine/threonine kinase 38 like
  Uniprot ID: Q9Y2H1
  ENSP ID: ENSP00000373684
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIDDTSNFDDFPESDILQPVPNTTEPDYKSKDWVFLNYTYKRFEGLTQRGSIPTYMKAGKL

SEQ ID NO: 77922 - protein, 89 aa, Homo sapiens
  Payload ID: 15526
  Gene Symbol: STK38L
  Gene Name: serine/threonine kinase 38 like
  ENSP ID: ENSP00000385174
  MOD_RES (1)..(1): Any amino acid
XQKKLEVAMEEEGLADEEKKLRRSQHARKETEFLRLKRTRLGLDDFESLKVIGRGAFGEVRLVQKKDTGHIYAMKILRKSDMLEKEQVT

SEQ ID NO: 77923 - protein, 131 aa, Homo sapiens
  Payload ID: 15526
  Gene Symbol: STK38L
  Gene Name: serine/threonine kinase 38 like
  ENSP ID: ENSP00000437856
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQ

SEQ ID NO: 77924 - protein, 213 aa, Homo sapiens
  Payload ID: 15526
  Gene Symbol: STK38L
  Gene Name: serine/threonine kinase 38 like
  ENSP ID: ENSP00000439457
MAMTAGTTTTFPMSNHTRERVTVAKLTLENFYSNLILQHEERETRQKKLEVAMEEEGLADEEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNP

SEQ ID NO: 77925 - protein, 131 aa, Homo sapiens; identical to SEQ ID NO: 77923
  Payload ID: 15526
  Gene Symbol: STK38L
  Gene Name: serine/threonine kinase 38 like
  ENSP ID: ENSP00000440279

SEQ ID NO: 77926 - protein, 131 aa, Homo sapiens; identical to SEQ ID NO: 77923
  Payload ID: 15526
  Gene Symbol: STK38L
  Gene Name: serine/threonine kinase 38 like
  ENSP ID: ENSP00000442253

SEQ ID NO: 77927 - protein, 56 aa, Homo sapiens
  Payload ID: 15526
  Gene Symbol: STK38L
  Gene Name: serine/threonine kinase 38 like
  ENSP ID: ENSP00000443456
MAMTAGTTTTFPMSNHTRERVTVAKLTLENFYSNLILQHEERETRGENWKSFNKQH

SEQ ID NO: 77928 - protein, 94 aa, Homo sapiens
  Payload ID: 15526
  Gene Symbol: STK38L
  Gene Name: serine/threonine kinase 38 like
  ENSP ID: ENSP00000443838
MAMTAGTTTTFPMSNHTRERVTVAKLTLENFYSNLILQHEERETRQKKLEVAMEEEGLADEEKKLRRSQHARKETEFLRLKRTRLGLDDFESLK

SEQ ID NO: 77929 - protein, 87 aa, Homo sapiens
  Payload ID: 15526
  Gene Symbol: STK38L
  Gene Name: serine/threonine kinase 38 like
  ENSP ID: ENSP00000443961
YISETVLAIDAIHQLGFIHRDIKPDNLLLDAKGHVKLSDFGLCTGLKKAHRTEFYRNLTHNPPSDFYVYVFSFCGEHFSLVITIPYC

SEQ ID NO: 77930 - protein, 64 aa, Homo sapiens
  Payload ID: 15526
  Gene Symbol: STK38L
  Gene Name: serine/threonine kinase 38 like
  ENSP ID: ENSP00000445898
MAMTAGTTTTFPMSNHTRERVTVAKLTLENFYSNLILQHEERETRQKKLEVAMEEEGLADEEVM

SEQ ID NO: 77931 - protein, 462 aa, Homo sapiens
  Payload ID: 15527
  Gene Symbol: STK4
  Gene Name: serine/threonine kinase 4
  Uniprot ID: Q13043
  ENSP ID: ENSP00000361887
METVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFKTSQEQQSGKDICIQNCQGNLLCRYAF

SEQ ID NO: 77932 - protein, 487 aa, Homo sapiens
  Payload ID: 15527
  Gene Symbol: STK4
  Gene Name: serine/threonine kinase 4
  Uniprot ID: Q13043
  ENSP ID: ENSP00000361892
METVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFLKSWTVEDLQKRLLALDPMMEQEIEEIRQKYQSKRQPILDAIEAKKRRQQNF

SEQ ID NO: 77933 - protein, 432 aa, Homo sapiens
  Payload ID: 15527
  Gene Symbol: STK4
  Gene Name: serine/threonine kinase 4
  ENSP ID: ENSP00000443514
METVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGAGSVSDIIRLRNKTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMKRRDETMQPAKPSFLEYFEQKEKENQINSFGKSVPGPLKNSSDWKIPQDGDYEFLKSWTVEDLQKRLLALDPMMEQEIEEIRQKYQSKRQPILDAIEAKKRRQQNF

SEQ ID NO: 77934 - protein, 155 aa, Homo sapiens
  Payload ID: 15527
  Gene Symbol: STK4
  Gene Name: serine/threonine kinase 4
  ENSP ID: ENSP00000479564
MQQCDSPHVVKYYGSYFKNTDLWIVMEYCGAGSVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMR

SEQ ID NO: 77935 - protein, 64 aa, Homo sapiens
  Payload ID: 15527
  Gene Symbol: STK4
  Gene Name: serine/threonine kinase 4
  ENSP ID: ENSP00000482076
METVQLRNPPRRQLKKLDEDSLTKQPEEVFDVLEKLGEGWKNTLWNPARNQAEKGSKNDTPAVL

SEQ ID NO: 77936 - protein, 417 aa, Homo sapiens
  Payload ID: 15528
  Gene Symbol: STK40
  Gene Name: serine/threonine kinase 40
  Uniprot ID: Q8N2I9
  ENSP ID: ENSP00000352245
MKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEVSWGGQMGHYPAPRDRLLGAGRARAEVAATRRPQSFLGLLPQPWGGKGRLQSSA

SEQ ID NO: 77937 - protein, 435 aa, Homo sapiens
  Payload ID: 15528
  Gene Symbol: STK40
  Gene Name: serine/threonine kinase 40
  Uniprot ID: Q8N2I9
  ENSP ID: ENSP00000362221
MKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEAKVTEECSQYEFENYMRQQLLLAEEKSSIHDARSWVPKRQFGSAPPVRRLGHDAQPMTSLDTAILAQRYLRK

SEQ ID NO: 77938 - protein, 440 aa, Homo sapiens
  Payload ID: 15528
  Gene Symbol: STK40
  Gene Name: serine/threonine kinase 40
  Uniprot ID: Q8N2I9
  ENSP ID: ENSP00000362222
MKRRASDRGAGETSARAKALGSGISGNNAKRAGPFILALCAVGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEAKVTEECSQYEFENYMRQQLLLAEEKSSIHDARSWVPKRQFGSAPPVRRLGHDAQPMTSLDTAILAQRYLRK

SEQ ID NO: 77939 - protein, 435 aa, Homo sapiens; identical to SEQ ID NO: 77937
  Payload ID: 15528
  Gene Symbol: STK40
  Gene Name: serine/threonine kinase 40
  Uniprot ID: Q8N2I9
  ENSP ID: ENSP00000362224

SEQ ID NO: 77940 - protein, 363 aa, Homo sapiens
  Payload ID: 15529
  Gene Symbol: STRAP
  Gene Name: serine/threonine kinase receptor associated protein
  Uniprot ID: Q9Y3F4
  ENSP ID: ENSP00000025399
MAMRQTPLTCSGHTRPVVDLAFSGITPYGYFLISACKGAGQHLPRLSGQHDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 77941 - protein, 350 aa, Homo sapiens
  Payload ID: 15529
  Gene Symbol: STRAP
  Gene Name: serine/threonine kinase receptor associated protein
  Uniprot ID: Q9Y3F4
  ENSP ID: ENSP00000392270
MAMRQTPLTCSGHTRPVVDLAFSGITPYGYFLISACKDGKPMLRQGDTGDWIGTFLGHKGAVWGATLNKDATKAATAAADFTAKVWDAVSGDELMTLAHKHIVKTVDFTQDSNYLLTGGQDKLLRIYDLNKPEAEPKEISGHTSGIKKALWCSEDKQILSADDKTVRLWDHATMTEVKSLNFNMSVSSMEYIPEGEILVITYGRSIAFHSAVSLDPIKSFEAPATINSASLHPEKEFLVAGGEDFKLYKYDYNSGEELESYKGHFGPIHCVRFSPDGELYASGSEDGTLRLWQTVVGKTYGLWKCVLPEEDSGELAKPKIGFPETTEEELEEIASENSDCIFPSAPDVKA

SEQ ID NO: 77942 - protein, 46 aa, Homo sapiens
  Payload ID: 15529
  Gene Symbol: STRAP
  Gene Name: serine/threonine kinase receptor associated protein
  ENSP ID: ENSP00000445693
MRQTPLTCSGHTRPVVDLAFSGITPYGYFLISACKAKCGMLSQEMN

SEQ ID NO: 77943 - protein, 95 aa, Homo sapiens
  Payload ID: 15529
  Gene Symbol: STRAP
  Gene Name: serine/threonine kinase receptor associated protein
  ENSP ID: ENSP00000445814
  MOD_RES (1)..(1): Any amino acid
XKEFLVAGGEDFKLYKYDYNSGEELESYKGHFGPIHCVRFSPDGELYASGSEDGTLRLWQTVVGKTYGLWKCVLPEEIASENSDCIFPSAPDVKA

SEQ ID NO: 77944 - protein, 680 aa, Homo sapiens
  Payload ID: 15530
  Gene Symbol: STKLD1
  Gene Name: serine/threonine kinase-like domain containing 1
  Uniprot ID: Q8NE28
  ENSP ID: ENSP00000361025
MLGPGSNRRRPTQGERGPGSPGEPMEKYQVLYQLNPGALGVNLVVEEMETKVKHVIKQVECMDDHYASQALEELMPLLKLRHAHISVYQELFITWNGEISSLYLCLVMEFNELSFQEVIEDKRKAKKIIDSEWMQNVLGQVLDALEYLHHLDIIHRNLKPSNIILISSDHCKLQDLSSNVLMTDKAKWNIRAEEDPFRKSWMAPEALNFSFSQKSDIWSLGCIILDMTSCSFMDGTEAMHLRKSLRQSPGSLKAVLKTMEEKQIPDVETFRNLLPLMLQIDPSDRITIKDVVHITFLRGSFKSSCVSLTLHRQMVPASITDMLLEGNVASILEVMQKFSGWPEVQLRAMKRLLKMPADQLGLPWPPELVEVVVTTMELHDRVLDVQLCACSLLLHLLGQALVHHPEAKAPCNQAITSTLLSALQSHPEEEPLLVMVYSLLAITTTQESESLSEELQNAGLLEHILEHLNSSLESRDVCASGLGLLWALLLDGIIVNKAPLEKVPDLISQVLATYPADGEMAEASCGVFWLLSLLGCIKEQQFEQVVALLLQSIRLCQDRALLVNNAYRGLASLVKVSELAAFKVVVQEEGGSGLSLIKETYQLHRDDPEVVENVGMLLVHLASYEEILPELVSSSMKALLQEIKERFTSSLVSDSSAFSKPGLPPGGSPQLGCTTSGGLE

SEQ ID NO: 77945 - protein, 680 aa, Homo sapiens; identical to SEQ ID NO: 77944
  Payload ID: 15530
  Gene Symbol: STKLD1
  Gene Name: Serine/threonine kinase-like domain containing 1
  ENSP ID: ENSP00000486786

SEQ ID NO: 77946 - protein, 392 aa, Homo sapiens
  Payload ID: 15531
  Gene Symbol: STK26
  Gene Name: serine/threonine protein kinase 26
  ENSP ID: ENSP00000346755
MAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAQDENNASRNQAIEELEKSIAVAEAACPGITDKMVKKLIEKFQKCSADESP

SEQ ID NO: 77947 - protein, 416 aa, Homo sapiens
  Payload ID: 15531
  Gene Symbol: STK26
  Gene Name: serine/threonine protein kinase 26
  Uniprot ID: Q9P289
  ENSP ID: ENSP00000377867
MAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 77948 - protein, 339 aa, Homo sapiens
  Payload ID: 15531
  Gene Symbol: STK26
  Gene Name: serine/threonine protein kinase 26
  Uniprot ID: Q9P289
  ENSP ID: ENSP00000377868
MAHSPVAVQVPGMQGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 77949 - protein, 438 aa, Homo sapiens
  Payload ID: 15531
  Gene Symbol: STK26
  Gene Name: serine/threonine protein kinase 26
  ENSP ID: ENSP00000418753
MAHSPVAVQVPGMQNNIADPEELFTKLERIGKGSFGEVFKGIDNRTQQVVAIKIIDLEEAEDEIEDIQQEITVLSQCDSSYVTKYYGSYLKDHGISRHLKFQQMEVLLHSRKLGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 77950 - protein, 354 aa, Homo sapiens
  Payload ID: 15531
  Gene Symbol: STK26
  Gene Name: serine/threonine protein kinase 26
  Uniprot ID: Q9P289
  ENSP ID: ENSP00000419702
MAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 77951 - protein, 223 aa, Homo sapiens
  Payload ID: 15532
  Gene Symbol: STYX
  Gene Name: serine/threonine/tyrosine interacting protein
  Uniprot ID: Q8WUJ0
  ENSP ID: ENSP00000346599
MEDVKLEFPSLPQCKEDAEEWTYPMRREMQEILPGLFLGPYSSAMKSKLPVLQKHGITHIICIRQNIEANFIKPNFQQLFRYLVLDIADNPVENIIRFFPMTKEFIDGSLQMGGKVLVHGNAGISRSAAFVIAYIMETFGMKYRDAFAYVQERRFCINPNAGFVHQLQEYEAIYLAKLTIQMMSPLQIERSLSVHSGTTGSLKRTHEEEDDFGTMQVATAQNG

SEQ ID NO: 77952 - protein, 223 aa, Homo sapiens; identical to SEQ ID NO: 77951
  Payload ID: 15532
  Gene Symbol: STYX
  Gene Name: serine/threonine/tyrosine interacting protein
  Uniprot ID: Q8WUJ0
  ENSP ID: ENSP00000403214

SEQ ID NO: 77953 - protein, 313 aa, Homo sapiens
  Payload ID: 15533
  Gene Symbol: STYXL1
  Gene Name: serine/threonine/tyrosine interacting-like 1
  Uniprot ID: Q9Y6J8
  ENSP ID: ENSP00000248600
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGISRSCAAIIAYLMHSNEQTLQRSWAYVKKCKNNMCPNRGLVSQLLEWEKTILGDSITNIMDPLY

SEQ ID NO: 77954 - protein, 217 aa, Homo sapiens
  Payload ID: 15533
  Gene Symbol: STYXL1
  Gene Name: serine/threonine/tyrosine interacting-like 1
  Uniprot ID: Q9Y6J8
  ENSP ID: ENSP00000343383
MPGLLLCEPTELYNILNQATKLSRLTDPNYLCLLDVRSKWEYDESHVITALRVKKELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGISRSCAAIIAYLMHSNEQTLQRSWAYVKKCKNNMCPNRGLVSQLLEWEKTILGDSITNIMDPLY

SEQ ID NO: 77955 - protein, 313 aa, Homo sapiens; identical to SEQ ID NO: 77953
  Payload ID: 15533
  Gene Symbol: STYXL1
  Gene Name: serine/threonine/tyrosine interacting-like 1
  Uniprot ID: Q9Y6J8
  ENSP ID: ENSP00000352726

SEQ ID NO: 77956 - protein, 217 aa, Homo sapiens; identical to SEQ ID NO: 77954
  Payload ID: 15533
  Gene Symbol: STYXL1
  Gene Name: serine/threonine/tyrosine interacting-like 1
  Uniprot ID: Q9Y6J8
  ENSP ID: ENSP00000353798

SEQ ID NO: 77957 - protein, 313 aa, Homo sapiens; identical to SEQ ID NO: 77953
  Payload ID: 15533
  Gene Symbol: STYXL1
  Gene Name: serine/threonine/tyrosine interacting-like 1
  Uniprot ID: Q9Y6J8
  ENSP ID: ENSP00000392221

SEQ ID NO: 77958 - protein, 68 aa, Homo sapiens
  Payload ID: 15533
  Gene Symbol: STYXL1
  Gene Name: serine/threonine/tyrosine interacting-like 1
  ENSP ID: ENSP00000403033
  MOD_RES (1)..(1): Any amino acid
XHVITALRVKKKNNEYLLPESVDLECVKYCVVYDNNSSTLEILLKDDDDDSDSDGDGKGTGCISAIPH

SEQ ID NO: 77959 - protein, 68 aa, Homo sapiens; identical to SEQ ID NO: 77958
  Payload ID: 15533
  Gene Symbol: STYXL1
  Gene Name: serine/threonine/tyrosine interacting-like 1
  ENSP ID: ENSP00000404495
  MOD_RES (1)..(1): Any amino acid

SEQ ID NO: 77960 - protein, 221 aa, Homo sapiens
  Payload ID: 15533
  Gene Symbol: STYXL1
  Gene Name: serine/threonine/tyrosine interacting-like 1
  ENSP ID: ENSP00000406073
HVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEVLGLCQEVQKQHVSKSGIGEPAAGMGEDYPWRF

SEQ ID NO: 77961 - protein, 282 aa, Homo sapiens
  Payload ID: 15533
  Gene Symbol: STYXL1
  Gene Name: serine/threonine/tyrosine interacting-like 1
  ENSP ID: ENSP00000411812
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGISRSCAAIIAYLMHSNEQTLQTESRSVTQAGVQ

SEQ ID NO: 77962 - protein, 422 aa, Homo sapiens
  Payload ID: 15534
  Gene Symbol: STYK1
  Gene Name: serine/threonine/tyrosine kinase 1
  Uniprot ID: Q6J9G0
  ENSP ID: ENSP00000075503
MGMTRMLLECSLSDKLCVIQEKQYEVIIVPTLLVTIFLILLGVILWLFIREQRTQQQRSGPQGIAPVPPPRDLSWEAGHGGNVALPLKETSVENFLGATTPALAKLQVPREQLSEVLEQICSGSCGPIFRANMNTGDPSKPKSVILKALKEPAGLHEVQDFLGRIQFHQYLGKHKNLVQLEGCCTEKLPLYMVLEDVAQGDLLSFLWTCRRDVMTMDGLLYDLTEKQVYHIGKQVLLALEFLQEKHLFHGDVAARNILMQSDLTAKLCGLGLAYEVYTRGAISSTQTIPLKWLAPERLLLRPASIRADVWSFGILLYEMVTLGAPPYPEVPPTSILEHLQRRKIMKRPSSCTHTMYSIMKSCWRWREADRPSPRELRLRLEAAIKTADDEAVLQVPELVVPELYAAVAGIRVESLFYNYSML

SEQ ID NO: 77963 - protein, 83 aa, Homo sapiens
  Payload ID: 15534
  Gene Symbol: STYK1
  Gene Name: serine/threonine/tyrosine kinase 1
  ENSP ID: ENSP00000443760
  MOD_RES (1)..(1): Any amino acid
XRIQFHQYLGKHKNLVQLEGCCTEKLPLYMVLEDVAQGDLLSFLWTCRRVSSRAEDVMTMDGLLYDLTEKQVYHIGKQVLLAL

SEQ ID NO: 77964 - protein, 65 aa, Homo sapiens
  Payload ID: 15534
  Gene Symbol: STYK1
  Gene Name: serine/threonine/tyrosine kinase 1
  ENSP ID: ENSP00000444488
MGMTRMLLECSLSDKLCVIQEKQYEVIIVPTLLVTIFLILLGVILWLFIREQRTQQQRSGPQGKA

SEQ ID NO: 77965 - protein, 40 aa, Homo sapiens
  Payload ID: 15534
  Gene Symbol: STYK1
  Gene Name: serine/threonine/tyrosine kinase 1
  ENSP ID: ENSP00000444942
MGMTRMLLECSLSDKLCVIQEKQYEVIIVPTLLVTIFLIL

SEQ ID NO: 77966 - protein, 83 aa, Homo sapiens
  Payload ID: 15534
  Gene Symbol: STYK1
  Gene Name: serine/threonine/tyrosine kinase 1
  ENSP ID: ENSP00000445391
MGMTRMLLECSLSDKLCVIQEKQYEVIIVPTLLVTIFLILLGVILWLFIREQRTQQQRSGPQGIAPVPPPRDLSWEAGHGGNV

SEQ ID NO: 77967 - protein, 87 aa, Homo sapiens
  Payload ID: 15534
  Gene Symbol: STYK1
  Gene Name: serine/threonine/tyrosine kinase 1
  ENSP ID: ENSP00000446241
MGMTRMLLECSLSDKLCVIQEKQYEVIIVPTLLVTIFLILLGVILWLFIREQRTQQQRSGPQGIAPVPPPRDLSWEAGHGGNVALPL

SEQ ID NO: 77968 - protein, 107 aa, Homo sapiens
  Payload ID: 15535
  Gene Symbol: SERTM1
  Gene Name: serine-rich and transmembrane domain containing 1
  Uniprot ID: A2A2V5
  ENSP ID: ENSP00000325776
MSEPDTSSGFSGSVENGTFLELFPTSLSTSVDPSSGHLSNVYIYVSIFLSLLAFLLLLLIIALQRLKNIISSSSSYPEYPSDAGSSFTNLEVCSISSQRSTFSNLSS

SEQ ID NO: 77969 - protein, 244 aa, Homo sapiens
  Payload ID: 15536
  Gene Symbol: SSMEM1
  Gene Name: serine-rich single-pass membrane protein 1
  Uniprot ID: Q8WWF3
  ENSP ID: ENSP00000297819
MGDLFSLFWEVDPPPIPVNCAIPNQDYECWKDDSCGTIGSFLLWYFVIVFVLMFFSRASVWMSEDKKDEGSGTSTSVRKASKETSCKRQSKDSAWDPSQTMKKPKQNQLTPVTNSEVALVNAYPEQRRARRQSQFNEVNQNQHDSDTTEYGSEESNSEASSWKESESEHHPSPDSIKRRKMAQRQRNLGSYQMSERHCLHCKALRTNEWLAHHSRQKPSVTPPMKRDSQEESSISDINKKFSKF

SEQ ID NO: 77970 - protein, 412 aa, Homo sapiens
  Payload ID: 15537
  Gene Symbol: SDCCAG3
  Gene Name: serologically defined colon cancer antigen 3
  Uniprot ID: Q96C92
  ENSP ID: ENSP00000298537
MSGYQRRPGATPLSRARSLAIPDAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 77971 - protein, 435 aa, Homo sapiens
  Payload ID: 15537
  Gene Symbol: SDCCAG3
  Gene Name: serologically defined colon cancer antigen 3
  Uniprot ID: Q96C92
  ENSP ID: ENSP00000349929
MSGYQRRPGATPLSRARSLAIPDAPAFYERRSCLPQLNCERPHGRDLDSPFFGIRPAFMCYVPSPVLASVGDTDFGYGKGKCSKQSPSGAHGTHFGDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 77972 - protein, 223 aa, Homo sapiens
  Payload ID: 15537
  Gene Symbol: SDCCAG3
  Gene Name: serologically defined colon cancer antigen 3
  ENSP ID: ENSP00000360788
MSGYQRRPGATPLSRARSLAIPDDFGYGKGKCSKQSPSGAHGTHFGDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDA

SEQ ID NO: 77973 - protein, 362 aa, Homo sapiens
  Payload ID: 15537
  Gene Symbol: SDCCAG3
  Gene Name: serologically defined colon cancer antigen 3
  Uniprot ID: Q96C92
  ENSP ID: ENSP00000360790
MSGYQRRPGATPLSRARSLAIPDDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 77974 - protein, 167 aa, Homo sapiens
  Payload ID: 15537
  Gene Symbol: SDCCAG3
  Gene Name: serologically defined colon cancer antigen 3
  ENSP ID: ENSP00000409255
  MOD_RES (1)..(1): Any amino acid
XDRHLRTLQISYDALKDENSKLRRKLNEVQSFSEAQTEMVRTLERKLEAKMIKEESDYHDLESVVQQKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 77975 - protein, 108 aa, Homo sapiens
  Payload ID: 15537
  Gene Symbol: SDCCAG3
  Gene Name: serologically defined colon cancer antigen 3
  ENSP ID: ENSP00000409357
MCYVPSPVLASVGDTGERRGRRPRGRFQFPRHVWHLRCSTSSSIDPSMCRALTACQALGIQRRSPLLGAHSLVAGRPPPRQTVPVQDDDRFEDLEEANPFSFREFLKT

SEQ ID NO: 77976 - protein, 713 aa, Homo sapiens
  Payload ID: 15538
  Gene Symbol: SDCCAG8
  Gene Name: serologically defined colon cancer antigen 8
  Uniprot ID: Q86SQ7
  ENSP ID: ENSP00000355499
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 77977 - protein, 414 aa, Homo sapiens
  Payload ID: 15538
  Gene Symbol: SDCCAG8
  Gene Name: serologically defined colon cancer antigen 8
  ENSP ID: ENSP00000410200
LLDASEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 77978 - protein, 155 aa, Homo sapiens
  Payload ID: 15538
  Gene Symbol: SDCCAG8
  Gene Name: serologically defined colon cancer antigen 8
  ENSP ID: ENSP00000473868
  MOD_RES (1)..(1): Any amino acid
XQEETLREQTLLDASGNMHNSWITTGEDSGVGETSKRPFSHDNADFGKAASAGEQLELNFLIISNKKSGRIKQYLHSPPCQPLMTSLQLSEKLKLTYEEKCEIEESQLKFLRNKNHGRARWLTPVIPALWEAEAGESRGQEIETILANMVKPRFY

SEQ ID NO: 77979 - protein, 713 aa, Homo sapiens; identical to SEQ ID NO: 77976
  Payload ID: 15538
  Gene Symbol: SDCCAG8
  Gene Name: serologically defined colon cancer antigen 8
  Uniprot ID: Q86SQ7
  ENSP ID: ENSP00000483550

SEQ ID NO: 77980 - protein, 525 aa, Homo sapiens
  Payload ID: 15538
  Gene Symbol: SDCCAG8
  Gene Name: serologically defined colon cancer antigen 8
  ENSP ID: ENSP00000485978
MKNKIQVVVLENEGLQQQLKSQRQEETLREQTLLDASEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 77981 - protein, 409 aa, Homo sapiens
  Payload ID: 15538
  Gene Symbol: SDCCAG8
  Gene Name: serologically defined colon cancer antigen 8
  ENSP ID: ENSP00000486376
EKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 77982 - protein, 568 aa, Homo sapiens
  Payload ID: 15538
  Gene Symbol: SDCCAG8
  Gene Name: serologically defined colon cancer antigen 8
  ENSP ID: ENSP00000486441
MKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 77983 - protein, 418 aa, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000348068
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 77984 - protein, 418 aa, Homo sapiens; identical to SEQ ID NO: 77983
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000376802

SEQ ID NO: 77985 - protein, 418 aa, Homo sapiens; identical to SEQ ID NO: 77983
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000376803

SEQ ID NO: 77986 - protein, 418 aa, Homo sapiens; identical to SEQ ID NO: 77983
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000385960

SEQ ID NO: 77987 - protein, 359 aa, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000386094
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKVRSP

SEQ ID NO: 77988 - protein, 418 aa, Homo sapiens; identical to SEQ ID NO: 77983
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000390299

SEQ ID NO: 77989 - protein, 418 aa, Homo sapiens; identical to SEQ ID NO: 77983
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000408474

SEQ ID NO: 77990 - protein, 418 aa, Homo sapiens; identical to SEQ ID NO: 77983
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000416066

SEQ ID NO: 77991 - protein, 418 aa, Homo sapiens; identical to SEQ ID NO: 77983
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000416354

SEQ ID NO: 77992 - protein, 105 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000450561
MLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQG

SEQ ID NO: 77993 - protein, 117 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000451098
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIH

SEQ ID NO: 77994 - protein, 306 aa, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENSP ID: ENSP00000451525
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRR

SEQ ID NO: 77995 - protein, 22 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000451826
MPSSVSWGILLLAGLCCLVPVS

SEQ ID NO: 77996 - protein, 156 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000452169
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLE

SEQ ID NO: 77997 - protein, 144 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000452452
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFL

SEQ ID NO: 77998 - protein, 92 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000452480
MPSSVSWGILLLAGLCCLVPVSLAEDPQGDAAQKTDTSHHDQDHPTFNKITPNLAEFAFSLYRQLAHQSNSTNIFFSPVSIATAFAMLSLGT

SEQ ID NO: 77999 - protein, 418 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000477615
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQATTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 78000 - protein, 418 aa, Homo sapiens; identical to SEQ ID NO: 77999
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000479923

SEQ ID NO: 78001 - protein, 418 aa, Homo sapiens; identical to SEQ ID NO: 77999
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000480231

SEQ ID NO: 78002 - protein, 418 aa, Homo sapiens; identical to SEQ ID NO: 77999
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000485908

SEQ ID NO: 78003 - protein, 418 aa, Homo sapiens; identical to SEQ ID NO: 77999
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000486067

SEQ ID NO: 78004 - protein, 117 aa, Homo sapiens; identical to SEQ ID NO: 77993
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000486117

SEQ ID NO: 78005 - protein, 418 aa, Homo sapiens; identical to SEQ ID NO: 77999
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000486302

SEQ ID NO: 78006 - protein, 92 aa, Homo sapiens; identical to SEQ ID NO: 77998
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000486467

SEQ ID NO: 78007 - protein, 144 aa, Homo sapiens; identical to SEQ ID NO: 77997
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000486654

SEQ ID NO: 78008 - protein, 359 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000486935
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQATTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKVRSP

SEQ ID NO: 78009 - protein, 418 aa, Homo sapiens; identical to SEQ ID NO: 77999
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000486957

SEQ ID NO: 78010 - protein, 156 aa, Homo sapiens; identical to SEQ ID NO: 77996
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000487269

SEQ ID NO: 78011 - protein, 22 aa, Homo sapiens
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000487293
MPSSVSWGILLLAGLCCLVPVS

SEQ ID NO: 78012 - protein, 418 aa, Homo sapiens; identical to SEQ ID NO: 77999
  Payload ID: 15539
  Gene Symbol: SERPINA1
  Gene Name: serpin peptidase inhibitor, clade A (alpha-1 antiproteinase, antitrypsin), member 1
  ENSP ID: ENSP00000487579

SEQ ID NO: 78013 - protein, 444 aa, Homo sapiens
  Payload ID: 15540
  Gene Symbol: SERPINA10
  Gene Name: serpin peptidase inhibitor, clade A (alpha-1 antiproteinase, antitrypsin), member 10
  Uniprot ID: Q9UK55
  ENSP ID: ENSP00000261994
MKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 78014 - protein, 444 aa, Homo sapiens; identical to SEQ ID NO: 78013
  Payload ID: 15540
  Gene Symbol: SERPINA10
  Gene Name: serpin peptidase inhibitor, clade A (alpha-1 antiproteinase, antitrypsin), member 10
  Uniprot ID: Q9UK55
  ENSP ID: ENSP00000376809

SEQ ID NO: 78015 - protein, 484 aa, Homo sapiens
  Payload ID: 15540
  Gene Symbol: SERPINA10
  Gene Name: serpin peptidase inhibitor, clade A (alpha-1 antiproteinase, antitrypsin), member 10
  ENSP ID: ENSP00000450896
MSRSTQELLGYHCRLQDKLQEQEGSLAAEGRHSLASAADHMKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 78016 - protein, 444 aa, Homo sapiens; identical to SEQ ID NO: 78013
  Payload ID: 15540
  Gene Symbol: SERPINA10
  Gene Name: serpin peptidase inhibitor, clade A (alpha-1 antiproteinase, antitrypsin), member 10
  Uniprot ID: Q9UK55
  ENSP ID: ENSP00000450971

SEQ ID NO: 78017 - protein, 484 aa, Homo sapiens; identical to SEQ ID NO: 78015
  Payload ID: 15540
  Gene Symbol: SERPINA10
  Gene Name: serpin peptidase inhibitor, clade A (alpha-1 antiproteinase, antitrypsin), member 10
  ENSP ID: ENSP00000482029

SEQ ID NO: 78018 - protein, 444 aa, Homo sapiens; identical to SEQ ID NO: 78013
  Payload ID: 15540
  Gene Symbol: SERPINA10
  Gene Name: serpin peptidase inhibitor, clade A (alpha-1 antiproteinase, antitrypsin), member 10
  Uniprot ID: Q9UK55
  ENSP ID: ENSP00000484632

SEQ ID NO: 78019 - protein, 422 aa, Homo sapiens
  Payload ID: 15541
  Gene Symbol: SERPINA11
  Gene Name: serpin peptidase inhibitor, clade A (alpha-1 antiproteinase, antitrypsin), member 11
  Uniprot ID: Q86U17
  ENSP ID: ENSP00000335024
MGPAWLWLLGTGILASVHCQPLLAHGDKSLQGPQPPRHQLSEPAPAYHRITPTITNFALRLYKELAADAPGNIFFSPVSISTTLALLSLGAQANTSALILEGLGFNLTETPEADIHQGFRSLLHTLALPSPKLELKVGNSLFLDKRLKPRQHYLDSIKELYGAFAFSANFTDSVTTGRQINDYLRRQTYGQVVDCLPEFSQDTFMVLANYIFFKAKWKHPFSRYQTQKQESFFVDERTSLQVPMMHQKEMHRFLYDQDLACTVLQIEYRGNALALLVLPDPGKMKQVEAALQPQTLRKWGQLLLPSLLDLHLPRFSISGTYNLEDILPQIGLTNILNLEADFSGVTGQLNKTISKVSHKAMVDMSEKGTEAGAASGLLSQPPSLNTMSDPHAHFNRPFLLLLWEVTTQSLLFLGKVVNPVAG

SEQ ID NO: 78020 - protein, 414 aa, Homo sapiens
  Payload ID: 15542
  Gene Symbol: SERPINA12
  Gene Name: serpin peptidase inhibitor, clade A (alpha-1 antiproteinase, antitrypsin), member 12
  Uniprot ID: Q8IW75
  ENSP ID: ENSP00000342109
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 78021 - protein, 414 aa, Homo sapiens; identical to SEQ ID NO: 78020
  Payload ID: 15542
  Gene Symbol: SERPINA12
  Gene Name: serpin peptidase inhibitor, clade A (alpha-1 antiproteinase, antitrypsin), member 12
  Uniprot ID: Q8IW75
  ENSP ID: ENSP00000451738

SEQ ID NO: 78022 - protein, 421 aa, Homo sapiens
  Payload ID: 15543
  Gene Symbol: SERPINA2
  Gene Name: serpin peptidase inhibitor, clade A (alpha-1 antiproteinase, antitrypsin), member 2 (gene/pseudogene)
  ENSP ID: ENSP00000477957
MPFSVSWGILLLAGLCCLVPSSLVEDPQEDAAQKTDTSHHDQGDWEDLACQKISYNVTDLAFDLYKELADLSQTSNVLVTPTSVAMAFAMLSLGTKADTRTEILEGLNVNLTETPEAKIHECFQQVLQALSRPDTRLQLTTGSSLFVNKSMKLVDTFLEDTKKLYHSEASSINFRDTEEAKEQINNYVEKRTGRKVVDLVKHLKKDTSLALVDYISFHGKWKDKFKAEHIMVEGFHVDDKTIIRVPMINHLGRFDIHRDRELSSWVLAQHYVGNATAFFILPDPKKMWQLEEKLTYSHLENIQRAFDIRSINLHFPKLSISGTYKLKRVLRNLGITKIFSNEADLSGVSQEAPLKLSKAVHVAVLTIDEKGTEATGAPHLEEKAWSKYQTVMFNRPFLVIIKDDITNFPLFIGKVVNPTQK

SEQ ID NO: 78023 - protein, 421 aa, Homo sapiens; identical to SEQ ID NO: 78022
  Payload ID: 15543
  Gene Symbol: SERPINA2
  Gene Name: serpin peptidase inhibitor, clade A (alpha-1 antiproteinase, antitrypsin), member 2 (gene/pseudogene)
  ENSP ID: ENSP00000483813

SEQ ID NO: 78024 - protein, 309 aa, Homo sapiens
  Payload ID: 15543
  Gene Symbol: SERPINA2
  Gene Name: serpin peptidase inhibitor, clade A (alpha-1 antiproteinase, antitrypsin), member 2 (gene/pseudogene)
  ENSP ID: ENSP00000486888
IPFSVSWGVLLLAGLCCLVPSSLVEDPQEDAAQKTDTSHHDQGDWEDLACQKISYNVTDLAFDLYKELADLSQTSNVLVTPTSVAMAFAMLSLGTKADTRTEILEGLNVNLTETPEAKIHECFQQVLQALSRPDTRLQLTTGSSLFVNKSMKLVDTFLEDTKKLYHSEASSINFRDTEEAKEQINNYVEKRTGRKVVDLVKHLKKDTSLALVDYISFHGKWKDKFKAERIMVEGFHVDDKTIIRVPMINHLGRFDIHRDRELSSWVLAQHYVGNATAFFILPDPKKMWQLEEKLTYSHLENIQRAFDIR

SEQ ID NO: 78025 - protein, 64 aa, Homo sapiens
  Payload ID: 15543
  Gene Symbol: SERPINA2
  Gene Name: serpin peptidase inhibitor, clade A (alpha-1 antiproteinase, antitrypsin), member 2 (gene/pseudogene)
  ENSP ID: ENSP00000487283
VKHLKKDTSLALVDYISFHGLSIYIFPNCPFLEPTNSRESLGIWASPRSSATRPTSLESVRRHP

SEQ ID NO: 78026 - protein, 423 aa, Homo sapiens
  Payload ID: 15544
  Gene Symbol: SERPINA3
  Gene Name: serpin peptidase inhibitor, clade A (alpha-1 antiproteinase, antitrypsin), member 3
  Uniprot ID: P01011
  ENSP ID: ENSP00000376795
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 78027 - protein, 423 aa, Homo sapiens; identical to SEQ ID NO: 78026
  Payload ID: 15544
  Gene Symbol: SERPINA3
  Gene Name: serpin peptidase inhibitor, clade A (alpha-1 antiproteinase, antitrypsin), member 3
  Uniprot ID: P01011
  ENSP ID: ENSP00000450540

SEQ ID NO: 78028 - protein, 205 aa, Homo sapiens
  Payload ID: 15544
  Gene Symbol: SERPINA3
  Gene Name: serpin peptidase inhibitor, clade A (alpha-1 antiproteinase, antitrypsin), member 3
  ENSP ID: ENSP00000451119
MPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 78029 - protein, 305 aa, Homo sapiens
  Payload ID: 15544
  Gene Symbol: SERPINA3
  Gene Name: serpin peptidase inhibitor, clade A (alpha-1 antiproteinase, antitrypsin), member 3
  ENSP ID: ENSP00000452246
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEF

SEQ ID NO: 78030 - protein, 216 aa, Homo sapiens
  Payload ID: 15544
  Gene Symbol: SERPINA3
  Gene Name: serpin peptidase inhibitor, clade A (alpha-1 antiproteinase, antitrypsin), member 3
  Uniprot ID: P01011
  ENSP ID: ENSP00000452476
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKER

SEQ ID NO: 78031 - protein, 46 aa, Homo sapiens
  Payload ID: 15544
  Gene Symbol: SERPINA3
  Gene Name: serpin peptidase inhibitor, clade A (alpha-1 antiproteinase, antitrypsin), member 3
  ENSP ID: ENSP00000481617
  MOD_RES (1)..(1): Any amino acid
XTVVELKYTGNASALFILPDQDKMEEVEAMLLPETLKRWRDSLEFR

SEQ ID NO: 78032 - protein, 423 aa, Homo sapiens; identical to SEQ ID NO: 78026
  Payload ID: 15545
  Gene Symbol:
  Gene Name: serpin peptidase inhibitor, clade A (alpha-1 antiproteinase, antitrypsin), member 3 [Source:EntrezGene
  Acc:12]
  ENSP ID: ENSP00000376793

SEQ ID NO: 78033 - protein, 45 aa, Homo sapiens
  Payload ID: 15545
  Gene Symbol:
  Gene Name: serpin peptidase inhibitor, clade A (alpha-1 antiproteinase, antitrypsin), member 3 [Source:EntrezGene
  Acc:12]
  ENSP ID: ENSP00000452367
  MOD_RES (1)..(1): Any amino acid
XVHKAVVEVDESGTRAAAATGTIFTFRYSLNGHCVPGTVPSAEEK

SEQ ID NO: 78034 - protein, 427 aa, Homo sapiens
  Payload ID: 15546
  Gene Symbol: SERPINA4
  Gene Name: serpin peptidase inhibitor, clade A (alpha-1 antiproteinase, antitrypsin), member 4
  Uniprot ID: P29622
  ENSP ID: ENSP00000298841
MHLIDYLLLLLVGLLALSHGQLHVEHDGESCSNSSHQQILETGEGSPSLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAKFLNDTMAVYEAKLFHTNFYDTVGTIQLINDHVKKETRGKIVDLVSELKKDVLMVLVNYIYFKALWEKPFISSRTTPKDFYVDENTTVRVPMMLQDQEHHWYLHDRYLPCSVLRMDYKGDATVFFILPNQGKMREIEEVLTPEMLMRWNNLLRKRNFYKKLELHLPKFSISGSYVLDQILPRLGFTDLFSKWADLSGITKQQKLEASKSFHKATLDVDEAGTEAAAATSFAIKFFSAQTNRHILRFNRPFLVVIFSTSTQSVLFLGKVVDPTKP

SEQ ID NO: 78035 - protein, 427 aa, Homo sapiens; identical to SEQ ID NO: 78034
  Payload ID: 15546
  Gene Symbol: SERPINA4
  Gene Name: serpin peptidase inhibitor, clade A (alpha-1 antiproteinase, antitrypsin), member 4
  Uniprot ID: P29622
  ENSP ID: ENSP00000450838

SEQ ID NO: 78036 - protein, 427 aa, Homo sapiens; identical to SEQ ID NO: 78034
  Payload ID: 15546
  Gene Symbol: SERPINA4
  Gene Name: serpin peptidase inhibitor, clade A (alpha-1 antiproteinase, antitrypsin), member 4
  Uniprot ID: P29622
  ENSP ID: ENSP00000451172

SEQ ID NO: 78037 - protein, 406 aa, Homo sapiens
  Payload ID: 15547
  Gene Symbol: SERPINA5
  Gene Name: serpin peptidase inhibitor, clade A (alpha-1 antiproteinase, antitrypsin), member 5
  Uniprot ID: P05154
  ENSP ID: ENSP00000333203
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 78038 - protein, 172 aa, Homo sapiens
  Payload ID: 15547
  Gene Symbol: SERPINA5
  Gene Name: serpin peptidase inhibitor, clade A (alpha-1 antiproteinase, antitrypsin), member 5
  ENSP ID: ENSP00000450484
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQI

SEQ ID NO: 78039 - protein, 157 aa, Homo sapiens
  Payload ID: 15547
  Gene Symbol: SERPINA5
  Gene Name: serpin peptidase inhibitor, clade A (alpha-1 antiproteinase, antitrypsin), member 5
  ENSP ID: ENSP00000450485
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADT

SEQ ID NO: 78040 - protein, 231 aa, Homo sapiens
  Payload ID: 15547
  Gene Symbol: SERPINA5
  Gene Name: serpin peptidase inhibitor, clade A (alpha-1 antiproteinase, antitrypsin), member 5
  ENSP ID: ENSP00000450745
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVV

SEQ ID NO: 78041 - protein, 406 aa, Homo sapiens; identical to SEQ ID NO: 78037
  Payload ID: 15547
  Gene Symbol: SERPINA5
  Gene Name: serpin peptidase inhibitor, clade A (alpha-1 antiproteinase, antitrypsin), member 5
  Uniprot ID: P05154
  ENSP ID: ENSP00000450837

SEQ ID NO: 78042 - protein, 406 aa, Homo sapiens; identical to SEQ ID NO: 78037
  Payload ID: 15547
  Gene Symbol: SERPINA5
  Gene Name: serpin peptidase inhibitor, clade A (alpha-1 antiproteinase, antitrypsin), member 5
  Uniprot ID: P05154
  ENSP ID: ENSP00000451126

SEQ ID NO: 78043 - protein, 90 aa, Homo sapiens
  Payload ID: 15547
  Gene Symbol: SERPINA5
  Gene Name: serpin peptidase inhibitor, clade A (alpha-1 antiproteinase, antitrypsin), member 5
  ENSP ID: ENSP00000451215
MQLFLLLCLVLLSPQGASLHRHHPREMKKRVEDLHVGATVAPSSRRDFTFDLYRALASAAPSQSIFFSPVSISMSLAMLSLGAGSSTKMQ

SEQ ID NO: 78044 - protein, 24 aa, Homo sapiens
  Payload ID: 15547
  Gene Symbol: SERPINA5
  Gene Name: serpin peptidase inhibitor, clade A (alpha-1 antiproteinase, antitrypsin), member 5
  ENSP ID: ENSP00000451487
MQLFLLLCLVLLSPQGASLHRHHP

SEQ ID NO: 78045 - protein, 406 aa, Homo sapiens; identical to SEQ ID NO: 78037
  Payload ID: 15547
  Gene Symbol: SERPINA5
  Gene Name: serpin peptidase inhibitor, clade A (alpha-1 antiproteinase, antitrypsin), member 5
  Uniprot ID: P05154
  ENSP ID: ENSP00000451610

SEQ ID NO: 78046 - protein, 144 aa, Homo sapiens
  Payload ID: 15547
  Gene Symbol: SERPINA5
  Gene Name: serpin peptidase inhibitor, clade A (alpha-1 antiproteinase, antitrypsin), member 5
  ENSP ID: ENSP00000451650
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDT

SEQ ID NO: 78047 - protein, 86 aa, Homo sapiens
  Payload ID: 15547
  Gene Symbol: SERPINA5
  Gene Name: serpin peptidase inhibitor, clade A (alpha-1 antiproteinase, antitrypsin), member 5
  ENSP ID: ENSP00000451697
MQLFLLLCLVLLSPQGASLHRHHPREMKKRVEDLHVGATVAPSSRRDFTFDLYRALASAAPSQSIFFSPVSISMSLAMLSLGAGSS

SEQ ID NO: 78048 - protein, 301 aa, Homo sapiens
  Payload ID: 15547
  Gene Symbol: SERPINA5
  Gene Name: serpin peptidase inhibitor, clade A (alpha-1 antiproteinase, antitrypsin), member 5
  ENSP ID: ENSP00000452469
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRYFQT

SEQ ID NO: 78049 - protein, 405 aa, Homo sapiens
  Payload ID: 15548
  Gene Symbol: SERPINA6
  Gene Name: serpin peptidase inhibitor, clade A (alpha-1 antiproteinase, antitrypsin), member 6
  Uniprot ID: P08185
  ENSP ID: ENSP00000342850
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDSELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 78050 - protein, 278 aa, Homo sapiens
  Payload ID: 15548
  Gene Symbol: SERPINA6
  Gene Name: serpin peptidase inhibitor, clade A (alpha-1 antiproteinase, antitrypsin), member 6
  ENSP ID: ENSP00000451045
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGIPTHPHLKAHPLWPGITAAKIQGTLLGKVFDSVKHIHIWESPSSPQSCWAHGHSPLTWQAPGRRTSMWTRQLW

SEQ ID NO: 78051 - protein, 136 aa, Homo sapiens
  Payload ID: 15548
  Gene Symbol: SERPINA6
  Gene Name: serpin peptidase inhibitor, clade A (alpha-1 antiproteinase, antitrypsin), member 6
  ENSP ID: ENSP00000452018
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGS

SEQ ID NO: 78052 - protein, 405 aa, Homo sapiens; identical to SEQ ID NO: 78049
  Payload ID: 15548
  Gene Symbol: SERPINA6
  Gene Name: serpin peptidase inhibitor, clade A (alpha-1 antiproteinase, antitrypsin), member 6
  Uniprot ID: P08185
  ENSP ID: ENSP00000484501

SEQ ID NO: 78053 - protein, 278 aa, Homo sapiens; identical to SEQ ID NO: 78050
  Payload ID: 15548
  Gene Symbol: SERPINA6
  Gene Name: serpin peptidase inhibitor, clade A (alpha-1 antiproteinase, antitrypsin), member 6
  ENSP ID: ENSP00000486588

SEQ ID NO: 78054 - protein, 136 aa, Homo sapiens; identical to SEQ ID NO: 78051
  Payload ID: 15548
  Gene Symbol: SERPINA6
  Gene Name: serpin peptidase inhibitor, clade A (alpha-1 antiproteinase, antitrypsin), member 6
  ENSP ID: ENSP00000486954

SEQ ID NO: 78055 - protein, 415 aa, Homo sapiens
  Payload ID: 15549
  Gene Symbol: SERPINA7
  Gene Name: serpin peptidase inhibitor, clade A (alpha-1 antiproteinase, antitrypsin), member 7
  Uniprot ID: P05543
  ENSP ID: ENSP00000329374
MSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 78056 - protein, 415 aa, Homo sapiens; identical to SEQ ID NO: 78055
  Payload ID: 15549
  Gene Symbol: SERPINA7
  Gene Name: serpin peptidase inhibitor, clade A (alpha-1 antiproteinase, antitrypsin), member 7
  Uniprot ID: P05543
  ENSP ID: ENSP00000361644

SEQ ID NO: 78057 - protein, 335 aa, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENSP ID: ENSP00000298845
MQGQGRRRGTCKDIFCSKMASYLYGVLFAVGLCAPIYCVSPANAPSAYPRPSSTKSTPASQVYSLNTDFAFRLYRRLVLETPSQNIFFSPARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 78058 - protein, 435 aa, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENSP ID: ENSP00000337133
MQGQGRRRGTCKDIFCSKMASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 78059 - protein, 417 aa, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENSP ID: ENSP00000369723
MASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 78060 - protein, 286 aa, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENSP ID: ENSP00000409012
MGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 78061 - protein, 337 aa, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENSP ID: ENSP00000414092
MLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 78062 - protein, 201 aa, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENSP ID: ENSP00000441511
MRSAGGRGEIKVRRELQPSKQVSGLTNHARTGQEKRNLQRHILFQNGILPLWSTLCCWPLCSNLLCVPGQCPQCIPPPFLHKEHPCLTGVFPQHRLCLPPIPQAGFGDPESEHLLLPCECLHFPGHALPWGPLSHQDPDSPGPGLQPHTHTRVCHPPGLPAPGSLTDCSQQRPDLEDGKCPLRQEGAAAAGKFLGQCQEAV

SEQ ID NO: 78063 - protein, 334 aa, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENSP ID: ENSP00000445476
MRSAGGRGEIKVRRELQPSKQVSGLTNHARTGQEKRNLQRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKVS

SEQ ID NO: 78064 - protein, 379 aa, Homo sapiens
  Payload ID: 15551
  Gene Symbol: SERPINB1
  Gene Name: serpin peptidase inhibitor, clade B (ovalbumin), member 1
  Uniprot ID: P30740
  ENSP ID: ENSP00000370115
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 78065 - protein, 397 aa, Homo sapiens
  Payload ID: 15552
  Gene Symbol: SERPINB10
  Gene Name: serpin peptidase inhibitor, clade B (ovalbumin), member 10
  Uniprot ID: P48595
  ENSP ID: ENSP00000238508
MDSLATSINQFALELSKKLAESAQGKNIFFSSWSISTSLTIVYLGAKGTTAAQMAQVLQFNRDQGVKCDPESEKKRKMEFNLSNSEEIHSDFQTLISEILKPNDDYLLKTANAIYGEKTYAFHNKYLEDMKTYFGAEPQPVNFVEASDQIRKDINSWVERQTEGKIQNLLPDDSVDSTTRMILVNALYFKGIWEHQFLVQNTTEKPFRINETTSKPVQMMFMKKKLHIFHIEKPKAVGLQLYYKSRDLSLLILLPEDINGLEQLEKAITYEKLNEWTSADMMELYEVQLHLPKFKLEDSYDLKSTLSSMGMSDAFSQSKADFSGMSSARNLFLSNVFHKAFVEINEQGTEAAAGSGSEIDIRIRVPSIEFNANHPFLFFIRHNKTNTILFYGRLCSP

SEQ ID NO: 78066 - protein, 280 aa, Homo sapiens
  Payload ID: 15552
  Gene Symbol: SERPINB10
  Gene Name: serpin peptidase inhibitor, clade B (ovalbumin), member 10
  ENSP ID: ENSP00000381082
  MOD_RES (1)..(1): Any amino acid
XSVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVELKVSQLFSHNLLLQEQIANSAPVGENKVSSMDSLATSINQFALELSKKLAESAQGKNIFFSSWSISTSLTIVYLGAKGTTAAQMAQVLQFNRDQGVK

SEQ ID NO: 78067 - protein, 253 aa, Homo sapiens
  Payload ID: 15552
  Gene Symbol: SERPINB10
  Gene Name: serpin peptidase inhibitor, clade B (ovalbumin), member 10
  ENSP ID: ENSP00000392381
  MOD_RES (1)..(1): Any amino acid
XSVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVSSMDSLATSINQFALELSKKLAESAQGKNIFFSSWSISTSLTIVYLGAKGTTAAQMAQVLQFNRDQGVK

SEQ ID NO: 78068 - protein, 397 aa, Homo sapiens; identical to SEQ ID NO: 78065
  Payload ID: 15552
  Gene Symbol: SERPINB10
  Gene Name: serpin peptidase inhibitor, clade B (ovalbumin), member 10
  Uniprot ID: P48595
  ENSP ID: ENSP00000479385

SEQ ID NO: 78069 - protein, 392 aa, Homo sapiens
  Payload ID: 15553
  Gene Symbol: SERPINB11
  Gene Name: serpin peptidase inhibitor, clade B (ovalbumin), member 11 (gene/pseudogene)
  Uniprot ID: Q96P15
  ENSP ID: ENSP00000421854
MGSLSTANVEFCLDVFKELNSNNIGDNIFFSSLSLLYALSMVLLGARGETEEQLEKVLHFSHTVDSLKPGFKDSPKCSQAGRIHSEFGVEFSQINQPDSNCTLSIANRLYGTKTMAFHQQYLSCSEKWYQARLQTVDFEQSTEETRKTINAWVENKTNGKVANLFGKSTIDPSSVMVLVNAIYFKGQWQNKFQVRETVKSPFQLSEGKNVTVEMMYQIGTFKLAFVKEPQMQVLELPYVNNKLSMIILLPVGIANLKQIEKQLNSGTFHEWTSSSNMMEREVEVHLPRFKLETKYELNSLLKSLGVTDLFNQVKADLSGMSPTKGLYLSKAIHKSYLDVSEEGTEAAAATGDSIAVKSLPMRAQFKANHPFLFFIRHTHTNTILFCGKLASP

SEQ ID NO: 78070 - protein, 392 aa, Homo sapiens; identical to SEQ ID NO: 78069
  Payload ID: 15553
  Gene Symbol: SERPINB11
  Gene Name: serpin peptidase inhibitor, clade B (ovalbumin), member 11 (gene/pseudogene)
  ENSP ID: ENSP00000441497

SEQ ID NO: 78071 - protein, 135 aa, Homo sapiens
  Payload ID: 15553
  Gene Symbol: SERPINB11
  Gene Name: serpin peptidase inhibitor, clade B (ovalbumin), member 11 (gene/pseudogene)
  ENSP ID: ENSP00000441708
MGSLSTANVEFCLDVFKELNSNNIGDNIFFSSLSLLYALSMVLLGARGETEEQLEKVLHFSHTVDSLKPGFKDSPKCSQAGRIHSEFGVEFSQINQPDSNCTLSIANRLYGTKTMAFHQEKSQISLERAQLTLHL

SEQ ID NO: 78072 - protein, 181 aa, Homo sapiens
  Payload ID: 15553
  Gene Symbol: SERPINB11
  Gene Name: serpin peptidase inhibitor, clade B (ovalbumin), member 11 (gene/pseudogene)
  ENSP ID: ENSP00000480275
MGSLSTANVEFCLDVFKELNSNNIGDNIFFSSLSLLYALSMVLLGARGETEEQLEKVLHFSHTVDSLKPGFKDSPKCSQAGRIHSEFGVEFSQINQPDSNCTLSIANRLYGTKTMAFHQQYLSCSEKWYQARLQTVDFEQSTEETRKTINAWVENKTNGKVANLFGKSTIDPSSVMVLVNA

SEQ ID NO: 78073 - protein, 190 aa, Homo sapiens
  Payload ID: 15553
  Gene Symbol: SERPINB11
  Gene Name: serpin peptidase inhibitor, clade B (ovalbumin), member 11 (gene/pseudogene)
  ENSP ID: ENSP00000485426
MGSLSTANVEFCLDVFKELNSNNIGDNIFFSSLSLLYALSMVLLGARGETEEQLEKIEKQLNSGTFHEWTSSSNMMEREVEVHLPRFKLETKYELNSLLKSLGVTDLFNQVKADLSGMSPTKGLYLSKAIHKSYLDVSEEGTEAAAATGDSIAVKSLPMRAQFKANHPFLFFIRHTHTNTILFCGKLASP

SEQ ID NO: 78074 - protein, 305 aa, Homo sapiens
  Payload ID: 15553
  Gene Symbol: SERPINB11
  Gene Name: serpin peptidase inhibitor, clade B (ovalbumin), member 11 (gene/pseudogene)
  ENSP ID: ENSP00000485532
MGSLSTANVEFCLDVFKELNSNNIGDNIFFSSLSLLYALSMVLLGARGETEEQLEKVLHFSHTVDSLKPGFKDSPKCSQAGRIHSEFGVEFSQINQPDSNCTLSIANRLYGTKTMAFHQGKNVTVEMMYQIGTFKLAFVKEPQMQVLELPYVNNKLSMIILLPVGIANLKQIEKQLNSGTFHEWTSSSNMMEREVEVHLPRFKLETKYELNSLLKSLGVTDLFNQVKADLSGMSPTKGLYLSKAIHKSYLDVSEEGTEAAAATGDSIAVKSLPMRAQFKANHPFLFFIRHTHTNTILFCGKLASP

SEQ ID NO: 78075 - protein, 405 aa, Homo sapiens
  Payload ID: 15554
  Gene Symbol: SERPINB12
  Gene Name: serpin peptidase inhibitor, clade B (ovalbumin), member 12
  Uniprot ID: Q96P63
  ENSP ID: ENSP00000269491
MDSLVTANTKFCFDLFQEIGKDDRHKNIFFSPLSLSAALGMVRLGARSDSAHQIDEVLHFNEFSQNESKEPDPCLKSNKQKAGSLNNESGLVSCYFGQLLSKLDRIKTDYTLSIANRLYGEQEFPICQEYLDGVIQFYHTTIESVDFQKNPEKSRQEINFWVECQSQGKIKELFSKDAINAETVLVLVNAVYFKAKWETYFDHENTVDAPFCLNANENKSVKMMTQKGLYRIGFIEEVKAQILEMRYTKGKLSMFVLLPSHSKDNLKGLEELERKITYEKMVAWSSSENMSEESVVLSFPRFTLEDSYDLNSILQDMGITDIFDETRADLTGISPSPNLYLSKIIHKTFVEVDENGTQAAAATGAVVSERSLRSWVEFNANHPFLFFIRHNKTQTILFYGRVCSP

SEQ ID NO: 78076 - protein, 425 aa, Homo sapiens
  Payload ID: 15554
  Gene Symbol: SERPINB12
  Gene Name: serpin peptidase inhibitor, clade B (ovalbumin), member 12
  Uniprot ID: Q96P63
  ENSP ID: ENSP00000372218
MDSLVTANTKFCFDLFQEIGKDDRHKNIFFSPLSLSAALGMVRLGARSDSAHQIDEVLHFNEFSQNESKEPDPCLKSNKQKVLADSSLEGQKKTTEPLDQQAGSLNNESGLVSCYFGQLLSKLDRIKTDYTLSIANRLYGEQEFPICQEYLDGVIQFYHTTIESVDFQKNPEKSRQEINFWVECQSQGKIKELFSKDAINAETVLVLVNAVYFKAKWETYFDHENTVDAPFCLNANENKSVKMMTQKGLYRIGFIEEVKAQILEMRYTKGKLSMFVLLPSHSKDNLKGLEELERKITYEKMVAWSSSENMSEESVVLSFPRFTLEDSYDLNSILQDMGITDIFDETRADLTGISPSPNLYLSKIIHKTFVEVDENGTQAAAATGAVVSERSLRSWVEFNANHPFLFFIRHNKTQTILFYGRVCSP

SEQ ID NO: 78077 - protein, 400 aa, Homo sapiens
  Payload ID: 15555
  Gene Symbol: SERPINB13
  Gene Name: serpin peptidase inhibitor, clade B (ovalbumin), member 13
  ENSP ID: ENSP00000269489
MDSLGAVSTRLGFDLFKELKKTNDGNIFFSPVGILTAIGMVLLGTRGATASQLEEVFHSEKETKSSRIKAEEKEVVRIKAEGKEIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 78078 - protein, 391 aa, Homo sapiens
  Payload ID: 15555
  Gene Symbol: SERPINB13
  Gene Name: serpin peptidase inhibitor, clade B (ovalbumin), member 13
  Uniprot ID: Q9UIV8
  ENSP ID: ENSP00000341584
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 78079 - protein, 158 aa, Homo sapiens
  Payload ID: 15555
  Gene Symbol: SERPINB13
  Gene Name: serpin peptidase inhibitor, clade B (ovalbumin), member 13
  ENSP ID: ENSP00000388300
MTCQDTALSICVRCPATTVSPKTRGLAKIIMDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYY

SEQ ID NO: 78080 - protein, 124 aa, Homo sapiens
  Payload ID: 15555
  Gene Symbol: SERPINB13
  Gene Name: serpin peptidase inhibitor, clade B (ovalbumin), member 13
  ENSP ID: ENSP00000391156
TNDGNIFFSPVGILTAIGMVLLGTRGATASQLEEVFHSEKETKSSRIKAEEKEVSTSKSVQMMTQSHSFSFTFLEDLQAKILGIPYKNNDLSMFVLLPNDIDGLEKVNHCSEDGVCNTSYASYF

SEQ ID NO: 78081 - protein, 165 aa, Homo sapiens
  Payload ID: 15555
  Gene Symbol: SERPINB13
  Gene Name: serpin peptidase inhibitor, clade B (ovalbumin), member 13
  ENSP ID: ENSP00000394592
MDSLGAVSTRLGFDLFKELKKTNDGNIFFSPVGILTAIGMVLLGTRGATASQLEEVFHSEKETKSSRIKAEEKEIENTEAVHQQFQKFLTEISKLTNDYELNITNRLFGEKTYLFLQKYLDYVEKYYHASLEPVDFVNAADESRKKINSWVESKTNDVETEAQRV

SEQ ID NO: 78082 - protein, 415 aa, Homo sapiens
  Payload ID: 15556
  Gene Symbol: SERPINB2
  Gene Name: serpin peptidase inhibitor, clade B (ovalbumin), member 2
  Uniprot ID: P05120
  ENSP ID: ENSP00000299502
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 78083 - protein, 113 aa, Homo sapiens
  Payload ID: 15556
  Gene Symbol: SERPINB2
  Gene Name: serpin peptidase inhibitor, clade B (ovalbumin), member 2
  ENSP ID: ENSP00000385397
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSA

SEQ ID NO: 78084 - protein, 132 aa, Homo sapiens
  Payload ID: 15556
  Gene Symbol: SERPINB2
  Gene Name: serpin peptidase inhibitor, clade B (ovalbumin), member 2
  ENSP ID: ENSP00000397096
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGE

SEQ ID NO: 78085 - protein, 415 aa, Homo sapiens; identical to SEQ ID NO: 78082
  Payload ID: 15556
  Gene Symbol: SERPINB2
  Gene Name: serpin peptidase inhibitor, clade B (ovalbumin), member 2
  Uniprot ID: P05120
  ENSP ID: ENSP00000401645

SEQ ID NO: 78086 - protein, 161 aa, Homo sapiens
  Payload ID: 15556
  Gene Symbol: SERPINB2
  Gene Name: serpin peptidase inhibitor, clade B (ovalbumin), member 2
  ENSP ID: ENSP00000402386
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLEC

SEQ ID NO: 78087 - protein, 390 aa, Homo sapiens
  Payload ID: 15557
  Gene Symbol: SERPINB3
  Gene Name: serpin peptidase inhibitor, clade B (ovalbumin), member 3
  Uniprot ID: P29508
  ENSP ID: ENSP00000283752
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKNTYKSIQMMRQYTSFHFASLEDVQAKVLEIPYKGKDLSMIVLLPNEIDGLQKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHCNHPFLFFIRQNKTNSILFYGRFSSP

SEQ ID NO: 78088 - protein, 338 aa, Homo sapiens
  Payload ID: 15557
  Gene Symbol: SERPINB3
  Gene Name: serpin peptidase inhibitor, clade B (ovalbumin), member 3
  Uniprot ID: P29508
  ENSP ID: ENSP00000329498
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHCNHPFLFFIRQNKTNSILFYGRFSSP

SEQ ID NO: 78089 - protein, 390 aa, Homo sapiens
  Payload ID: 15557
  Gene Symbol: SERPINB3
  Gene Name: serpin peptidase inhibitor, clade B (ovalbumin), member 3
  ENSP ID: ENSP00000348795
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKNTYKSIQMMRQYTSFHFASLEDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 78090 - protein, 390 aa, Homo sapiens
  Payload ID: 15558
  Gene Symbol: SERPINB4
  Gene Name: serpin peptidase inhibitor, clade B (ovalbumin), member 4
  Uniprot ID: P48594
  ENSP ID: ENSP00000343445
MNSLSEANTKFMFDLFQQFRKSKENNIFYSPISITSALGMVLLGAKDNTAQQISKVLHFDQVTENTTEKAATYHVDRSGNVHHQFQKLLTEFNKSTDAYELKIANKLFGEKTYQFLQEYLDAIKKFYQTSVESTDFANAPEESRKKINSWVESQTNEKIKNLFPDGTIGNDTTLVLVNAIYFKGQWENKFKKENTKEEKFWPNKNTYKSVQMMRQYNSFNFALLEDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 78091 - protein, 371 aa, Homo sapiens
  Payload ID: 15558
  Gene Symbol: SERPINB4
  Gene Name: serpin peptidase inhibitor, clade B (ovalbumin), member 4
  ENSP ID: ENSP00000398645
  MOD_RES (1)..(1): Any amino acid
XTMNSLSEANTKFMFDLFQQFRKSKENNIFYSPISITSALGMVLLGAKDNTAQQISKVLHFDQVTENTTEKAATYHVDRSGNVHHQFQKLLTEFNKSTDAYELKIANKLFGEKTYQFLQEYLDAIKKFYQTSVESTDFANAPEESRKKINSWVESQTNEKIKNLFPDGTIGNDTTLVLVNAIYFKGQWENKFKKENTKEEKFWPNKDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 78092 - protein, 211 aa, Homo sapiens
  Payload ID: 15558
  Gene Symbol: SERPINB4
  Gene Name: serpin peptidase inhibitor, clade B (ovalbumin), member 4
  ENSP ID: ENSP00000399796
MNSLSEANTKFMFDLFQQFRKSKENNIFYSPISITSALGMVLLGAKDNTAQQISKVLHFDQVTENTTEKAATYHEYLDAIKKFYQTSVESTDFANAPEESRKKINSWVESQTNEKIKNLFPDGTIGNDTTLVLVNAIYFKGQWENKFKKENTKEEKFWPNKNTYKSVQMMRQYNSFNFALLEDVQAKVLEIPYKGKDLSMIVLLPNEIDGL

SEQ ID NO: 78093 - protein, 375 aa, Homo sapiens
  Payload ID: 15559
  Gene Symbol: SERPINB5
  Gene Name: serpin peptidase inhibitor, clade B (ovalbumin), member 5
  Uniprot ID: P36952
  ENSP ID: ENSP00000372221
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 78094 - protein, 129 aa, Homo sapiens
  Payload ID: 15559
  Gene Symbol: SERPINB5
  Gene Name: serpin peptidase inhibitor, clade B (ovalbumin), member 5
  ENSP ID: ENSP00000408821
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETK

SEQ ID NO: 78095 - protein, 231 aa, Homo sapiens
  Payload ID: 15559
  Gene Symbol: SERPINB5
  Gene Name: serpin peptidase inhibitor, clade B (ovalbumin), member 5
  Uniprot ID: P36952
  ENSP ID: ENSP00000467158
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKVCGAACSSKRSPIIDVKNDRDRVGHKSIPMRNLRARPAKCLS

SEQ ID NO: 78096 - protein, 376 aa, Homo sapiens
  Payload ID: 15560
  Gene Symbol: SERPINB6
  Gene Name: serpin peptidase inhibitor, clade B (ovalbumin), member 6
  Uniprot ID: P35237
  ENSP ID: ENSP00000338358
MDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 78097 - protein, 376 aa, Homo sapiens; identical to SEQ ID NO: 78096
  Payload ID: 15560
  Gene Symbol: SERPINB6
  Gene Name: serpin peptidase inhibitor, clade B (ovalbumin), member 6
  Uniprot ID: P35237
  ENSP ID: ENSP00000369891

SEQ ID NO: 78098 - protein, 376 aa, Homo sapiens; identical to SEQ ID NO: 78096
  Payload ID: 15560
  Gene Symbol: SERPINB6
  Gene Name: serpin peptidase inhibitor, clade B (ovalbumin), member 6
  Uniprot ID: P35237
  ENSP ID: ENSP00000369896

SEQ ID NO: 78099 - protein, 376 aa, Homo sapiens; identical to SEQ ID NO: 78096
  Payload ID: 15560
  Gene Symbol: SERPINB6
  Gene Name: serpin peptidase inhibitor, clade B (ovalbumin), member 6
  Uniprot ID: P35237
  ENSP ID: ENSP00000369901

SEQ ID NO: 78100 - protein, 376 aa, Homo sapiens; identical to SEQ ID NO: 78096
  Payload ID: 15560
  Gene Symbol: SERPINB6
  Gene Name: serpin peptidase inhibitor, clade B (ovalbumin), member 6
  Uniprot ID: P35237
  ENSP ID: ENSP00000369912

SEQ ID NO: 78101 - protein, 376 aa, Homo sapiens; identical to SEQ ID NO: 78096
  Payload ID: 15560
  Gene Symbol: SERPINB6
  Gene Name: serpin peptidase inhibitor, clade B (ovalbumin), member 6
  Uniprot ID: P35237
  ENSP ID: ENSP00000369919

SEQ ID NO: 78102 - protein, 380 aa, Homo sapiens
  Payload ID: 15560
  Gene Symbol: SERPINB6
  Gene Name: serpin peptidase inhibitor, clade B (ovalbumin), member 6
  ENSP ID: ENSP00000481398
MSAIMDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 78103 - protein, 395 aa, Homo sapiens
  Payload ID: 15560
  Gene Symbol: SERPINB6
  Gene Name: serpin peptidase inhibitor, clade B (ovalbumin), member 6
  ENSP ID: ENSP00000484343
MSSRQRGNFNYKLAFKSAIMDVLAEANGTFALNLLKTLGKDNSKNVFFSPMSMSCALAMVYMGAKGNTAAQMAQILSFNKSGGGGDIHQGFQSLLTEVNKTGTQYLLRMANRLFGEKSCDFLSSFRDSCQKFYQAEMEELDFISAVEKSRKHINTWVAEKTEGKIAELLSPGSVDPLTRLVLVNAVYFRGNWDEQFDKENTEERLFKVSKNEEKPVQMMFKQSTFKKTYIGEIFTQILVLPYVGKELNMIIMLPDETTDLRTVEKELTYEKFVEWTRLDMMDEEEVEVSLPRFKLEESYDMESVLRNLGMTDAFELGKADFSGMSQTDLSLSKVVHKSFVEVNEEGTEAAAATAAIMMMRCARFVPRFCADHPFLFFIQHSKTNGILFCGRFSSP

SEQ ID NO: 78104 - protein, 380 aa, Homo sapiens
  Payload ID: 15561
  Gene Symbol: SERPINB7
  Gene Name: serpin peptidase inhibitor, clade B (ovalbumin), member 7
  Uniprot ID: O75635
  ENSP ID: ENSP00000337212
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVERVDFTNHLEDTRRNINKWVENETHGKIKNVIGEGGISSSAVMVLVNAVYFKGKWQSAFTKSETINCHFKSPKCSGKAVAMMHQERKFNLSVIEDPSMKILELRYNGGINMYVLLPENDLSEIENKLTFQNLMEWTNPRRMTSKYVEVFFPQFKIEKNYEMKQYLRALGLKDIFDESKADLSGIASGGRLYISRMMHKSYIEVTEEGTEATAATGSNIVEKQLPQSTLFRADHPFLFVIRKDDIILFSGKVSCP

SEQ ID NO: 78105 - protein, 380 aa, Homo sapiens; identical to SEQ ID NO: 78104
  Payload ID: 15561
  Gene Symbol: SERPINB7
  Gene Name: serpin peptidase inhibitor, clade B (ovalbumin), member 7
  Uniprot ID: O75635
  ENSP ID: ENSP00000381101

SEQ ID NO: 78106 - protein, 128 aa, Homo sapiens
  Payload ID: 15561
  Gene Symbol: SERPINB7
  Gene Name: serpin peptidase inhibitor, clade B (ovalbumin), member 7
  ENSP ID: ENSP00000393947
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVER

SEQ ID NO: 78107 - protein, 127 aa, Homo sapiens
  Payload ID: 15561
  Gene Symbol: SERPINB7
  Gene Name: serpin peptidase inhibitor, clade B (ovalbumin), member 7
  ENSP ID: ENSP00000397301
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVE

SEQ ID NO: 78108 - protein, 164 aa, Homo sapiens
  Payload ID: 15561
  Gene Symbol: SERPINB7
  Gene Name: serpin peptidase inhibitor, clade B (ovalbumin), member 7
  ENSP ID: ENSP00000402362
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVERVDFTNHLEDTRRNINKWVENETHGKIKNVIGEGGIS

SEQ ID NO: 78109 - protein, 363 aa, Homo sapiens
  Payload ID: 15561
  Gene Symbol: SERPINB7
  Gene Name: serpin peptidase inhibitor, clade B (ovalbumin), member 7
  Uniprot ID: O75635
  ENSP ID: ENSP00000444572
MASLAAANAEFCFNLFREMDDNQGNGNVFFSSLSLFAALALVRLGAQDDSLSQIDKSGLQSQLKRVFSDINASHKDYDLSIVNGLFAEKVYGFHKDYIECAEKLYDAKVERVDFTNHLEDTRRNINKWVENETHGKIKNVIGEGGISSSAVMVLVNAVYFKGKWQSAFTKSETINCHFKSPKCSGKAVAMMHQERKFNLSVIEDPSMKILELRYNGGINMYVLLPENDLSEIENKLTFQNLMEWTNPRRMTSKYVEVFFPQFKIEKNYEMKQYLRALGLKDIFDESKADLSGIASGGRLYISRMMHKSYIEVTEEGTEATAATGSNIVEKQLPQSTLFRADHPFLFVIRKDDIILFSGKVSCP

SEQ ID NO: 78110 - protein, 380 aa, Homo sapiens; identical to SEQ ID NO: 78104
  Payload ID: 15561
  Gene Symbol: SERPINB7
  Gene Name: serpin peptidase inhibitor, clade B (ovalbumin), member 7
  Uniprot ID: O75635
  ENSP ID: ENSP00000444861

SEQ ID NO: 78111 - protein, 189 aa, Homo sapiens
  Payload ID: 15562
  Gene Symbol: SERPINB8
  Gene Name: serpin peptidase inhibitor, clade B (ovalbumin), member 8
  ENSP ID: ENSP00000295211
  MOD_RES (1)..(1): Any amino acid
XLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVIKAGGEL

SEQ ID NO: 78112 - protein, 374 aa, Homo sapiens
  Payload ID: 15562
  Gene Symbol: SERPINB8
  Gene Name: serpin peptidase inhibitor, clade B (ovalbumin), member 8
  Uniprot ID: P50452
  ENSP ID: ENSP00000331368
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVVEKALTYEKFKAWTNSEKLTKSKVQVFLPRLKLEESYDLEPFLRRLGMIDAFDEAKADFSGMSTEKNVPLSKVAHKCFVEVNEEGTEAAAATAVVRNSRCSRMEPRFCADHPFLFFIRHHKTNCILFCGRFSSP

SEQ ID NO: 78113 - protein, 374 aa, Homo sapiens; identical to SEQ ID NO: 78112
  Payload ID: 15562
  Gene Symbol: SERPINB8
  Gene Name: serpin peptidase inhibitor, clade B (ovalbumin), member 8
  Uniprot ID: P50452
  ENSP ID: ENSP00000381072

SEQ ID NO: 78114 - protein, 242 aa, Homo sapiens
  Payload ID: 15562
  Gene Symbol: SERPINB8
  Gene Name: serpin peptidase inhibitor, clade B (ovalbumin), member 8
  Uniprot ID: P50452
  ENSP ID: ENSP00000381075
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNAIYFKGKWNEQFDRKYTRGMLFKTNEEKKTVQMMFKEAKFKMGYADEVHTQVLELPYVEEELSMVILLPDDNTDLAVKE

SEQ ID NO: 78115 - protein, 164 aa, Homo sapiens
  Payload ID: 15562
  Gene Symbol: SERPINB8
  Gene Name: serpin peptidase inhibitor, clade B (ovalbumin), member 8
  ENSP ID: ENSP00000393456
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAEDTEECRKHINDWVAEKTEGKISEVLDAGTVDPLTKLVLVNA

SEQ ID NO: 78116 - protein, 124 aa, Homo sapiens
  Payload ID: 15562
  Gene Symbol: SERPINB8
  Gene Name: serpin peptidase inhibitor, clade B (ovalbumin), member 8
  ENSP ID: ENSP00000414580
MDDLCEANGTFAISLFKILGEEDNSRNVFFSPMSISSALAMVFMGAKGSTAAQMSQALCLYKDGDIHRGFQSLLSEVNRTGTQYLLRTANRLFGEKTCDFLPDFKEYCQKFYQAELEELSFAED

SEQ ID NO: 78117 - protein, 192 aa, Homo sapiens
  Payload ID: 15562
  Gene Symbol: SERPINB8
  Gene Name: serpin peptidase inhibitor, clade B (ovalbumin), member 8
  Uniprot ID: P50452
  ENSP ID: ENSP00000438328
MLFKTNEEKKTVQMMFKEAKFKMGYADEVHTQVLELPYVEEELSMVILLPDDNTDLAVVEKALTYEKFKAWTNSEKLTKSKVQVFLPRLKLEESYDLEPFLRRLGMIDAFDEAKADFSGMSTEKNVPLSKVAHKCFVEVNEEGTEAAAATAVVRNSRCSRMEPRFCADHPFLFFIRHHKTNCILFCGRFSSP

SEQ ID NO: 78118 - protein, 43 aa, Homo sapiens
  Payload ID: 15562
  Gene Symbol: SERPINB8
  Gene Name: serpin peptidase inhibitor, clade B (ovalbumin), member 8
  ENSP ID: ENSP00000478199
  MOD_RES (1)..(1): Any amino acid
XLPYVEEELSMVILLPDDNTDLAVDTLRSTSFFCDILANIIST

SEQ ID NO: 78119 - protein, 376 aa, Homo sapiens
  Payload ID: 15563
  Gene Symbol: SERPINB9
  Gene Name: serpin peptidase inhibitor, clade B (ovalbumin), member 9
  Uniprot ID: P50453
  ENSP ID: ENSP00000370074
METLSNASGTFAIRLLKILCQDNPSHNVFCSPVSISSALAMVLLGAKGNTATQMAQALSLNTEEDIHRAFQSLLTEVNKAGTQYLLRTANRLFGEKTCQFLSTFKESCLQFYHAELKELSFIRAAEESRKHINTWVSKKTEGKIEELLPGSSIDAETRLVLVNAIYFKGKWNEPFDETYTREMPFKINQEEQRPVQMMYQEATFKLAHVGEVRAQLLELPYARKELSLLVLLPDDGVELSTVEKSLTFEKLTAWTKPDCMKSTEVEVLLPKFKLQEDYDMESVLRHLGIVDAFQQGKADLSAMSAERDLCLSKFVHKSFVEVNEEGTEAAAASSCFVVAECCMESGPRFCADHPFLFFIRHNRANSILFCGRFSSP

SEQ ID NO: 78120 - protein, 464 aa, Homo sapiens
  Payload ID: 15564
  Gene Symbol: SERPINC1
  Gene Name: serpin peptidase inhibitor, clade C (antithrombin), member 1
  Uniprot ID: P01008
  ENSP ID: ENSP00000356671
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 78121 - protein, 259 aa, Homo sapiens
  Payload ID: 15564
  Gene Symbol: SERPINC1
  Gene Name: serpin peptidase inhibitor, clade C (antithrombin), member 1
  ENSP ID: ENSP00000478688
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNDLYVSDAFHKAFLEVNEEGSEAAASTAVVIAGRSLNPNRVTFKANRPFLVFIREVPLNTIIFMGRVANPCVK

SEQ ID NO: 78122 - protein, 499 aa, Homo sapiens
  Payload ID: 15565
  Gene Symbol: SERPIND1
  Gene Name: serpin peptidase inhibitor, clade D (heparin cofactor), member 1
  Uniprot ID: P05546
  ENSP ID: ENSP00000215727
MKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 78123 - protein, 499 aa, Homo sapiens; identical to SEQ ID NO: 78122
  Payload ID: 15565
  Gene Symbol: SERPIND1
  Gene Name: serpin peptidase inhibitor, clade D (heparin cofactor), member 1
  Uniprot ID: P05546
  ENSP ID: ENSP00000384050

SEQ ID NO: 78124 - protein, 402 aa, Homo sapiens [sequence omitted]

SEQ ID NO: 78125 - protein, 398 aa, Homo sapiens
  Payload ID: 15567
  Gene Symbol: SERPINE2
  Gene Name: serpin peptidase inhibitor, clade E (nexin, plasminogen activator inhibitor type 1), member 2
  Uniprot ID: P07093
  ENSP ID: ENSP00000258405
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITTGSENLHVSHILQKAKIEVSEDGTKASAATTAILIARSSPPWFIVDRPFLFFIRHNPTGAVLFMGQINKP

SEQ ID NO: 78126 - protein, 397 aa, Homo sapiens
  Payload ID: 15567
  Gene Symbol: SERPINE2
  Gene Name: serpin peptidase inhibitor, clade E (nexin, plasminogen activator inhibitor type 1), member 2
  Uniprot ID: P07093
  ENSP ID: ENSP00000386412
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 78127 - protein, 397 aa, Homo sapiens; identical to SEQ ID NO: 78126
  Payload ID: 15567
  Gene Symbol: SERPINE2
  Gene Name: serpin peptidase inhibitor, clade E (nexin, plasminogen activator inhibitor type 1), member 2
  Uniprot ID: P07093
  ENSP ID: ENSP00000386969

SEQ ID NO: 78128 - protein, 42 aa, Homo sapiens
  Payload ID: 15567
  Gene Symbol: SERPINE2
  Gene Name: serpin peptidase inhibitor, clade E (nexin, plasminogen activator inhibitor type 1), member 2
  ENSP ID: ENSP00000394518
MNWHLPLFLLASVTLPSICSHFNPLSLEELGSNTGIQVFNQI

SEQ ID NO: 78129 - protein, 86 aa, Homo sapiens
  Payload ID: 15567
  Gene Symbol: SERPINE2
  Gene Name: serpin peptidase inhibitor, clade E (nexin, plasminogen activator inhibitor type 1), member 2
  ENSP ID: ENSP00000399655
MNWHLPLFLLASVTLPSICSHFNPLSLEELGSNTGIQVFNQIVKSRPHDNIVISPHGIASVLGMLQLGADGRTKKQLAMVMRYGVN

SEQ ID NO: 78130 - protein, 275 aa, Homo sapiens
  Payload ID: 15567
  Gene Symbol: SERPINE2
  Gene Name: serpin peptidase inhibitor, clade E (nexin, plasminogen activator inhibitor type 1), member 2
  ENSP ID: ENSP00000408452
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTK

SEQ ID NO: 78131 - protein, 409 aa, Homo sapiens
  Payload ID: 15567
  Gene Symbol: SERPINE2
  Gene Name: serpin peptidase inhibitor, clade E (nexin, plasminogen activator inhibitor type 1), member 2
  Uniprot ID: P07093
  ENSP ID: ENSP00000415786
MSDCRSSLVEGTMNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 78132 - protein, 47 aa, Homo sapiens
  Payload ID: 15568
  Gene Symbol: SERPINE3
  Gene Name: serpin peptidase inhibitor, clade E (nexin, plasminogen activator inhibitor type 1), member 3
  ENSP ID: ENSP00000427824
MPPFLITLFLFHSCCLRANGHLREGMTLLKTEFALHLYQSVAACRNE

SEQ ID NO: 78133 - protein, 424 aa, Homo sapiens
  Payload ID: 15568
  Gene Symbol: SERPINE3
  Gene Name: serpin peptidase inhibitor, clade E (nexin, plasminogen activator inhibitor type 1), member 3
  Uniprot ID: A8MV23
  ENSP ID: ENSP00000428316
MPPFLITLFLFHSCCLRANGHLREGMTLLKTEFALHLYQSVAACRNETNFVISPAGVSLPLEILQFGAEGSTGQQLADALGYTVHDKRVKDFLHAVYATLPTSSQGTEMELACSLFVQVGTPLSPCFVEHVSWWANSSLEPADLSEPNSTAIQTSEGASRETAGGGPSEGPGGWPWEQVSAAFAQLVLVSTMSFQGTWRKRFSSTDTQILPFTCAYGLVLQVPMMHQTTEVNYGQFQDTAGHQVGVLELPYLGSAVSLFLVLPRDKDTPLSHIEPHLTASTIHLWTTSLRRARMDVFLPRFRIQNQFNLKSILNSWGVTDLFDPLKANLKGISGQDGFYVSEAIHKAKIEVLEEGTKASGATALLLLKRSRIPIFKADRPFIYFLREPNTGITVFFDRIQIIYQCLSSNKGSFVHYPLKNKHSF

SEQ ID NO: 78134 - protein, 404 aa, Homo sapiens
  Payload ID: 15568
  Gene Symbol: SERPINE3
  Gene Name: serpin peptidase inhibitor, clade E (nexin, plasminogen activator inhibitor type 1), member 3
  Uniprot ID: A8MV23
  ENSP ID: ENSP00000430755
MPPFLITLFLFHSCCLRANGHLREGMTLLKTEFALHLYQSVAACRNETNFVISPAGVSLPLEILQFGAEGSTGQQLADALGYTVHDKRVKDFLHAVYATLPTSSQGTEMELACSLFVQVGTPLSPCFVEHVSWWANSSLEPADLSEPNSTAIQTSEGASRETAGGGPSEGPGGWPWEQVSAAFAQLVLVSTMSFQGTWRKRFSSTDTQILPFTCAYGLVLQVPMMHQTTEVNYGQFQDTAGHQVGVLELPYLGSAVSLFLVLPRDKDTPLSHIEPHLTASTIHLWTTSLRRARMDVFLPRFRIQNQFNLKSILNSWGVTDLFDPLKANLKGISGQDGFYVSEAIHKAKIEVLEEGTKASGATALLLLKRSRIPIFKADRPFIYFLREPNTGFVFSIGRVSNPLD

SEQ ID NO: 78135 - protein, 404 aa, Homo sapiens; identical to SEQ ID NO: 78134
  Payload ID: 15568
  Gene Symbol: SERPINE3
  Gene Name: serpin peptidase inhibitor, clade E (nexin, plasminogen activator inhibitor type 1), member 3
  Uniprot ID: A8MV23
  ENSP ID: ENSP00000441468

SEQ ID NO: 78136 - protein, 418 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  Uniprot ID: P36955
  ENSP ID: ENSP00000254722
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPSPGLQPAHLTFPLDYHLNQPFIFVLRDTDTGALLFIGKILDPRGP

SEQ ID NO: 78137 - protein, 99 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000458484
MKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNL

SEQ ID NO: 78138 - protein, 114 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000459107
MQALVLLLCIGALLGHSSCQNPASPPEEGSPDPDSTGALVEEEDPFFKVPVNKLAAAVSNFGYDLYRVRSSTSPTTNVLLSPLSVATALSALSLGLMPLTYFRKISKDENSLAT

SEQ ID NO: 78139 - protein, 132 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000459869
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAP

SEQ ID NO: 78140 - protein, 111 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000460842
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYD

SEQ ID NO: 78141 - protein, 87 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000460905
MQALVLLLCIGALLGHSSCQNPASPPEEGSPDPDSTGALVEEEDPFFKVPVNKLAAAVSNFGYDLYRVRSSTSPTTNVLLSPLSVAT

SEQ ID NO: 78142 - protein, 90 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000461214
MKGKLARSTKEIPDEISILLLGVAHFKGQWVTKFDSRKTSLEDFYLDEERTVRVPMMSDPKAVLRYGLDSDLSCKIAQLPLTGSMSIIFF

SEQ ID NO: 78143 - protein, 138 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000461405
MRSAFSFSVWRTSRWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDS

SEQ ID NO: 78144 - protein, 128 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000461660
MQALVLLLCIGALLGHSSCQNPASPPEEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASR

SEQ ID NO: 78145 - protein, 28 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000488345
MQALVLLLCIGALLGHSSCQNPASPPEE

SEQ ID NO: 78146 - protein, 28 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000488386
MQALVLLLCIGALLGHSSCQNPASPPEE

SEQ ID NO: 78147 - protein, 43 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000488572
MRRQQPLQFGQKGPRMQALVLLLCIGALLGHSSCQNPASPPEE

SEQ ID NO: 78148 - protein, 28 aa, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENSP ID: ENSP00000488890
MQALVLLLCIGALLGHSSCQNPASPPEE

SEQ ID NO: 78149 - protein, 491 aa, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENSP ID: ENSP00000321853
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 78150 - protein, 491 aa, Homo sapiens; identical to SEQ ID NO: 78149
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENSP ID: ENSP00000371493

SEQ ID NO: 78151 - protein, 264 aa, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENSP ID: ENSP00000402056
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQH

SEQ ID NO: 78152 - protein, 255 aa, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENSP ID: ENSP00000402286
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSF

SEQ ID NO: 78153 - protein, 427 aa, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENSP ID: ENSP00000403877
MALLWGLLVLSWSCLQGPCSVFSPVSAMEPLGRQLTSGPNQEQVSPLTLLKLGNQVQPGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 78154 - protein, 491 aa, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENSP ID: ENSP00000479005
MALLWGLLVLSWSCLQGPCSVFSPVSAMEPLGWQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 78155 - protein, 491 aa, Homo sapiens; identical to SEQ ID NO: 78154
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENSP ID: ENSP00000481874

SEQ ID NO: 78156 - protein, 427 aa, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENSP ID: ENSP00000483294
MALLWGLLVLSWSCLQGPCSVFSPVSAMEPLGWQLTSGPNQEQVSPLTLLKLGNQVQPGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 78157 - protein, 264 aa, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENSP ID: ENSP00000488065
MALLWGLLVLSWSCLQGPCSVFSPVSAMEPLGWQLTSGPNQEQVSPLTLLKLGNQEPGGQTALKSPPGVCSRDPTPEQTHRLARAMMAFTADLFSLVAQTSTCPNLILSPLSVALALSHLALGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQH

SEQ ID NO: 78158 - protein, 255 aa, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENSP ID: ENSP00000488707
MALLWGLLVLSWSCLQGPCSVFSPVSAMEPLGWQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSF

SEQ ID NO: 78159 - protein, 500 aa, Homo sapiens
  Payload ID: 15571
  Gene Symbol: SERPING1
  Gene Name: serpin peptidase inhibitor, clade G (C1 inhibitor), member 1
  Uniprot ID: P05155
  ENSP ID: ENSP00000278407
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 78160 - protein, 463 aa, Homo sapiens
  Payload ID: 15571
  Gene Symbol: SERPING1
  Gene Name: serpin peptidase inhibitor, clade G (C1 inhibitor), member 1
  ENSP ID: ENSP00000341861
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 78161 - protein, 505 aa, Homo sapiens
  Payload ID: 15571
  Gene Symbol: SERPING1
  Gene Name: serpin peptidase inhibitor, clade G (C1 inhibitor), member 1
  Uniprot ID: P05155
  ENSP ID: ENSP00000367574
MASRLTLLTLLLLLLAGFLEPQDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 78162 - protein, 448 aa, Homo sapiens
  Payload ID: 15571
  Gene Symbol: SERPING1
  Gene Name: serpin peptidase inhibitor, clade G (C1 inhibitor), member 1
  Uniprot ID: P05155
  ENSP ID: ENSP00000367575
MLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 78163 - protein, 543 aa, Homo sapiens
  Payload ID: 15571
  Gene Symbol: SERPING1
  Gene Name: serpin peptidase inhibitor, clade G (C1 inhibitor), member 1
  ENSP ID: ENSP00000384420
MGAGPGRGGGPWAPRVGAGSEAGWLRRSADVAAQMASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSEQPSHLFPLAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 78164 - protein, 160 aa, Homo sapiens
  Payload ID: 15571
  Gene Symbol: SERPING1
  Gene Name: serpin peptidase inhibitor, clade G (C1 inhibitor), member 1
  ENSP ID: ENSP00000384561
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAM

SEQ ID NO: 78165 - protein, 122 aa, Homo sapiens
  Payload ID: 15571
  Gene Symbol: SERPING1
  Gene Name: serpin peptidase inhibitor, clade G (C1 inhibitor), member 1
  ENSP ID: ENSP00000399746
MGAGPGRGGGPWAPRVGAGSEAGWLRRSADVAAQMASRLTLLTLLLLLLAGDRASSNPNATSSSSQDPESLQDRGEGKVATTVISKMLFVEPILEVSSLPTTNSTTNSATKITANTTDEPTT

SEQ ID NO: 78166 - protein, 86 aa, Homo sapiens
  Payload ID: 15571
  Gene Symbol: SERPING1
  Gene Name: serpin peptidase inhibitor, clade G (C1 inhibitor), member 1
  ENSP ID: ENSP00000431226
AKWKTTFDPKKTRMEPFHFKNSVIKVPMMNSKKYPVAHFIDQTLKAKPWPRQTLYILGWKQDSQVSSCISTILNGKMWGSCSSPTI

SEQ ID NO: 78167 - protein, 43 aa, Homo sapiens
  Payload ID: 15571
  Gene Symbol: SERPING1
  Gene Name: serpin peptidase inhibitor, clade G (C1 inhibitor), member 1
  ENSP ID: ENSP00000432554
MASRLTLLTLLLLLLAGGLGRTPKQTWRASSLTPRTSPVSTRP

SEQ ID NO: 78168 - protein, 43 aa, Homo sapiens; identical to SEQ ID NO: 78167
  Payload ID: 15571
  Gene Symbol: SERPING1
  Gene Name: serpin peptidase inhibitor, clade G (C1 inhibitor), member 1
  ENSP ID: ENSP00000435431

SEQ ID NO: 78169 - protein, 133 aa, Homo sapiens [sequence omitted]

SEQ ID NO: 78170 - protein, 418 aa, Homo sapiens
  Payload ID: 15572
  Gene Symbol: SERPINH1
  Gene Name: serpin peptidase inhibitor, clade H (heat shock protein 47), member 1, (collagen binding protein 1)
  Uniprot ID: P50454
  ENSP ID: ENSP00000350894
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 78171 - protein, 85 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000431384
MRSLLLLSAFCLLEAATLAERSAGLAFSLYQAMAKDQAVENILVSPVVVASSLGLVSLGGKATTASQAKAVLSAEQLRDEEVHAG

SEQ ID NO: 78172 - protein, 150 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000431827
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSS

SEQ ID NO: 78173 - protein, 165 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000432007
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRD

SEQ ID NO: 78174 - protein, 201 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000433532
MVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 78175 - protein, 418 aa, Homo sapiens; identical to SEQ ID NO: 78170
  Payload ID: 15572
  Gene Symbol: SERPINH1
  Gene Name: serpin peptidase inhibitor, clade H (heat shock protein 47), member 1, (collagen binding protein 1)
  Uniprot ID: P50454
  ENSP ID: ENSP00000434412

SEQ ID NO: 78176 - protein, 142 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000434482
MRSLLLLSAFCLLEAALAAEVKKPAAAAAPGTAEKLSPKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVT

SEQ ID NO: 78177 - protein, 418 aa, Homo sapiens; identical to SEQ ID NO: 78170
  Payload ID: 15572
  Gene Symbol: SERPINH1
  Gene Name: serpin peptidase inhibitor, clade H (heat shock protein 47), member 1, (collagen binding protein 1)
  Uniprot ID: P50454
  ENSP ID: ENSP00000434657

SEQ ID NO: 78178 - protein, 249 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000434964
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDE

SEQ ID NO: 78179 - protein, 247 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000435452
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYD

SEQ ID NO: 78180 - protein, 166 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000435936
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDK

SEQ ID NO: 78181 - protein, 295 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000436040
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMG

SEQ ID NO: 78182 - protein, 324 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000436305
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQVRGGPA

SEQ ID NO: 78183 - protein, 56 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000436306
  MOD_RES (1)..(1): Any amino acid
XNPFDQDIYGREELRSPKLFYADHPFIFLVRDTQSGSLLFIGRLVRPKGDKMRDEL

SEQ ID NO: 78184 - protein, 203 aa, Homo sapiens
  Payload ID: 15572
  Gene Symbol: SERPINH1
  Gene Name: serpin peptidase inhibitor, clade H (heat shock protein 47), member 1, (collagen binding protein 1)
  ENSP ID: ENSP00000437108
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNA

SEQ ID NO: 78185 - protein, 410 aa, Homo sapiens
  Payload ID: 15573
  Gene Symbol: SERPINI1
  Gene Name: serpin peptidase inhibitor, clade I (neuroserpin), member 1
  Uniprot ID: Q99574
  ENSP ID: ENSP00000295777
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 78186 - protein, 410 aa, Homo sapiens; identical to SEQ ID NO: 78185
  Payload ID: 15573
  Gene Symbol: SERPINI1
  Gene Name: serpin peptidase inhibitor, clade I (neuroserpin), member 1
  Uniprot ID: Q99574
  ENSP ID: ENSP00000397373

SEQ ID NO: 78187 - protein, 160 aa, Homo sapiens
  Payload ID: 15573
  Gene Symbol: SERPINI1
  Gene Name: serpin peptidase inhibitor, clade I (neuroserpin), member 1
  ENSP ID: ENSP00000420133
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTN

SEQ ID NO: 78188 - protein, 245 aa, Homo sapiens
  Payload ID: 15573
  Gene Symbol: SERPINI1
  Gene Name: serpin peptidase inhibitor, clade I (neuroserpin), member 1
  ENSP ID: ENSP00000420561
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIP

SEQ ID NO: 78189 - protein, 119 aa, Homo sapiens
  Payload ID: 15573
  Gene Symbol: SERPINI1
  Gene Name: serpin peptidase inhibitor, clade I (neuroserpin), member 1
  ENSP ID: ENSP00000420807
  MOD_RES (1)..(1): Any amino acid
XSRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 78190 - protein, 405 aa, Homo sapiens
  Payload ID: 15574
  Gene Symbol: SERPINI2
  Gene Name: serpin peptidase inhibitor, clade I (pancpin), member 2
  Uniprot ID: O75830
  ENSP ID: ENSP00000264677
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 78191 - protein, 405 aa, Homo sapiens; identical to SEQ ID NO: 78190
  Payload ID: 15574
  Gene Symbol: SERPINI2
  Gene Name: serpin peptidase inhibitor, clade I (pancpin), member 2
  Uniprot ID: O75830
  ENSP ID: ENSP00000417692

SEQ ID NO: 78192 - protein, 206 aa, Homo sapiens
  Payload ID: 15574
  Gene Symbol: SERPINI2
  Gene Name: serpin peptidase inhibitor, clade I (pancpin), member 2
  ENSP ID: ENSP00000417752
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKK

SEQ ID NO: 78193 - protein, 157 aa, Homo sapiens
  Payload ID: 15574
  Gene Symbol: SERPINI2
  Gene Name: serpin peptidase inhibitor, clade I (pancpin), member 2
  ENSP ID: ENSP00000419255
MDTIFLWSLLLLFFGSQASRCSAQKNTEFAVDLYQEVSLSHKDNIIFSPLGITLVLEMVQLGAKGKAQQQIRQTLKQQETSAEKKQEFTFNLANALYLQEGFTVKEQYLHGNKEFFQSAIKLVDFQDAKACAEMISTWVERKTDGKIKDMFSGEEFG

SEQ ID NO: 78194 - protein, 405 aa, Homo sapiens; identical to SEQ ID NO: 78190
  Payload ID: 15574
  Gene Symbol: SERPINI2
  Gene Name: serpin peptidase inhibitor, clade I (pancpin), member 2
  Uniprot ID: O75830
  ENSP ID: ENSP00000419407

SEQ ID NO: 78195 - protein, 405 aa, Homo sapiens; identical to SEQ ID NO: 78190
  Payload ID: 15574
  Gene Symbol: SERPINI2
  Gene Name: serpin peptidase inhibitor, clade I (pancpin), member 2
  Uniprot ID: O75830
  ENSP ID: ENSP00000420621

SEQ ID NO: 78196 - protein, 415 aa, Homo sapiens
  Payload ID: 15574
  Gene Symbol: SERPINI2
  Gene Name: serpin peptidase inhibitor, clade I (pancpin), member 2
  ENSP ID: ENSP00000481699
MIQNLMREVKMDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 78197 - protein, 393 aa, Homo sapiens
  Payload ID: 15575
  Gene Symbol: SERBP1
  Gene Name: SERPINE1 mRNA binding protein 1
  Uniprot ID: Q8NC51
  ENSP ID: ENSP00000354591
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSSFSHYSGLKHEDKRGGSGSHNWGTVKDELTDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 78198 - protein, 402 aa, Homo sapiens
  Payload ID: 15575
  Gene Symbol: SERBP1
  Gene Name: SERPINE1 mRNA binding protein 1
  Uniprot ID: Q8NC51
  ENSP ID: ENSP00000360029
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSGLKHEDKRGGSGSHNWGTVKDELTESPKYIQKQISYNYSDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 78199 - protein, 387 aa, Homo sapiens
  Payload ID: 15575
  Gene Symbol: SERBP1
  Gene Name: SERPINE1 mRNA binding protein 1
  Uniprot ID: Q8NC51
  ENSP ID: ENSP00000360033
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSGLKHEDKRGGSGSHNWGTVKDELTDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 78200 - protein, 408 aa, Homo sapiens
  Payload ID: 15575
  Gene Symbol: SERBP1
  Gene Name: SERPINE1 mRNA binding protein 1
  Uniprot ID: Q8NC51
  ENSP ID: ENSP00000360034
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSSFSHYSGLKHEDKRGGSGSHNWGTVKDELTESPKYIQKQISYNYSDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 78201 - protein, 77 aa, Homo sapiens
  Payload ID: 15576
  Gene Symbol: SRRT
  Gene Name: serrate, RNA effector molecule
  ENSP ID: ENSP00000396807
  MOD_RES (1)..(1): Any amino acid
XVHIMQHHVLPIQARLGSIAEIDLGVPPPVMKTFKEFLLSLDDSVDETEAVKRYNDYKLDFRRQQMQDFFLAHKDEE

SEQ ID NO: 78202 - protein, 148 aa, Homo sapiens
  Payload ID: 15576
  Gene Symbol: SRRT
  Gene Name: serrate, RNA effector molecule
  ENSP ID: ENSP00000398618
GPEFVRKHIFNKHAEKIEEVKKEVAFFNNFLTDAKRPALPEIKPAQPPGPAQILPPGLTPGLPYPHQTPQGLMPYGQPRPPILGYGGWFVETQGPLWNIGTWMPQTMLISFEPSPVPQSCIIHTCTTLSYEALRIFCTISLTANKSTS

SEQ ID NO: 78203 - protein, 47 aa, Homo sapiens
  Payload ID: 15576
  Gene Symbol: SRRT
  Gene Name: serrate, RNA effector molecule
  ENSP ID: ENSP00000400703
  MOD_RES (1)..(1): Any amino acid
XRPLHKTCSLFMRNIAPNISRAEIISLCKRYPGFMRVALSEPQPERR

SEQ ID NO: 78204 - protein, 112 aa, Homo sapiens
  Payload ID: 15576
  Gene Symbol: SRRT
  Gene Name: serrate, RNA effector molecule
  ENSP ID: ENSP00000400912
MAPSDRAMGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGG

SEQ ID NO: 78205 - protein, 499 aa, Homo sapiens
  Payload ID: 15576
  Gene Symbol: SRRT
  Gene Name: serrate, RNA effector molecule
  ENSP ID: ENSP00000410588
ESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGVPTGGPPYPHAPYGAGRGNYDAFRGQGGYPGKPRNRMVRGDPRAIVEYRDLDAPDDVDFF

SEQ ID NO: 78206 - protein, 872 aa, Homo sapiens
  Payload ID: 15576
  Gene Symbol: SRRT
  Gene Name: serrate, RNA effector molecule
  Uniprot ID: Q9BXP5
  ENSP ID: ENSP00000478341
MGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQSLTPGLPYPHQTPQGLMPYGQPRPPILGYGAGAVRPAVPTGGPPYPHAPYGAGRGNYDAFRGQGGYPGKPRNRMVRGDPRAIVEYRDLDAPDDVDFF

SEQ ID NO: 78207 - protein, 876 aa, Homo sapiens
  Payload ID: 15576
  Gene Symbol: SRRT
  Gene Name: serrate, RNA effector molecule
  Uniprot ID: Q9BXP5
  ENSP ID: ENSP00000480421
MGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGAGAVRPAVPTGGPPYPHAPYGAGRGNYDAFRGQGGYPGKPRNRMVRGDPRAIVEYRDLDAPDDVDFF

SEQ ID NO: 78208 - protein, 875 aa, Homo sapiens
  Payload ID: 15576
  Gene Symbol: SRRT
  Gene Name: serrate, RNA effector molecule
  Uniprot ID: Q9BXP5
  ENSP ID: ENSP00000481173
MGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGAGAVRPAVPTGGPPYPHAPYGAGRGNYDAFRGQGGYPGKPRNRMVRGDPRAIVEYRDLDAPDDVDFF

SEQ ID NO: 78209 - protein, 50 aa, Homo sapiens
  Payload ID: 15576
  Gene Symbol: SRRT
  Gene Name: serrate, RNA effector molecule
  ENSP ID: ENSP00000483348
MGDSDDEYDRRRRDKFRRERSDYDRSRERDERRRGDDWNDRDRVSLCHPG

SEQ ID NO: 78210 - protein, 871 aa, Homo sapiens
  Payload ID: 15576
  Gene Symbol: SRRT
  Gene Name: serrate, RNA effector molecule
  Uniprot ID: Q9BXP5
  ENSP ID: ENSP00000483556
MGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQSLTPGLPYPHQTPQGLMPYGQPRPPILGYGAGAVRPAVPTGGPPYPHAPYGAGRGNYDAFRGQGGYPGKPRNRMVRGDPRAIVEYRDLDAPDDVDFF

SEQ ID NO: 78211 - protein, 236 aa, Homo sapiens [sequence omitted]

SEQ ID NO: 78212 - protein, 314 aa, Homo sapiens
  Payload ID: 15578
  Gene Symbol: SERTAD2
  Gene Name: SERTA domain containing 2
  Uniprot ID: Q14140
  ENSP ID: ENSP00000326933
MLGKGGKRKFDEHEDGLEGKIVSPCDGPSKVSYTLQRQTIFNISLMKLYNHRPLTEPSLQKTVLINNMLRRIQEELKQEGSLRPMFTPSSQPTTEPSDSYREAPPAFSHLASPSSHPCDLGSTTPLEACLTPASLLEDDDDTFCTSQAMQPTAPTKLSPPALLPEKDSFSSALDEIEELCPTSTSTEAATAATDSVKGTSSEAGTQKLDGPQESRADDSKLMDSLPGNFEITTSTGFLTDLTLDDILFADIDTSMYDFDPCTSSSGTASKMAPVSADDLLKTLAPYSSQPVTPSQPFKMDLTELDHIMEVLVGS

SEQ ID NO: 78213 - protein, 196 aa, Homo sapiens
  Payload ID: 15579
  Gene Symbol: SERTAD3
  Gene Name: SERTA domain containing 3
  Uniprot ID: Q9UJW9
  ENSP ID: ENSP00000325414
MVGGLKRKHSDLEEEEERWEWSPAGLQSYQQALLRISLDKVQRSLGPRAPSLRRHVLIHNTLQQLQAALRLAPAPALPPEPLFLGEEDFSLSATIGSILRELDTSMDGTEPPQNPVTPLGLQNEVPPQPDPVFLEALSSRYLGDSGLDDFFLDIDTSAVEKEPARAPPEPPHNLFCAPGSWEWNELDHIMEIILGS

SEQ ID NO: 78214 - protein, 196 aa, Homo sapiens; identical to SEQ ID NO: 78213
  Payload ID: 15579
  Gene Symbol: SERTAD3
  Gene Name: SERTA domain containing 3
  Uniprot ID: Q9UJW9
  ENSP ID: ENSP00000375882

SEQ ID NO: 78215 - protein, 177 aa, Homo sapiens
  Payload ID: 15579
  Gene Symbol: SERTAD3
  Gene Name: SERTA domain containing 3
  ENSP ID: ENSP00000469245
MVGGLKRKHSDLEEEEERWEWSPAGLQSYQQALLRISLDKVQRSLGPRAPSLRRHVLIHNTLQQLQAALRLAPAPALPPEPLFLGEEDFSLSATIGSILRELDTSMDGTEPPQNPVTPLGLQNEVPPQPDPVFLEALSSRYLGDSGLDDFFLDIDTSAVEKEPARAPPEPPHNLFCA

SEQ ID NO: 78216 - protein, 91 aa, Homo sapiens
  Payload ID: 15579
  Gene Symbol: SERTAD3
  Gene Name: SERTA domain containing 3
  ENSP ID: ENSP00000472999
MVGGLKRKHSDLEEEEERWEWSPAGLQSYQQALLRISLDKVQRSLGPRAPSLRRHVLIHNTLQQLQAALRLAPAPALPPEPLFLGEEDFSL

SEQ ID NO: 78217 - protein, 356 aa, Homo sapiens
  Payload ID: 15580
  Gene Symbol: SERTAD4
  Gene Name: SERTA domain containing 4
  Uniprot ID: Q9NUC0
  ENSP ID: ENSP00000355979
MTLVLSMNRFCEPIVSEGAAEIAGYQTLWEADSYGGPSPPGPAQAPLQGDRGAGPPLAGSHYRGISNPITTSKITYFKRKYVEEEDFHPPLSSCSHKTISIFEERAHILYMSLEKLKFIDDPEVYLRRSVLINNLMKRIHGEIIMQNNWCFPACSFNGTSAQEWFMAQDCPYRKRPRMAKEECEKFHACCFYQECGGHYLNLPLSVNANVGSASTAASSPSASSSSSSSSSSPPLPLPSCSRQVDFDVGSASIYKSDGQIPANEIFVTNVRSLGVQEKAKLNDEKANDDTNRDGGPLSHEPVGNDLAFECKGQFYDYFETGYNERNNVNESWKKSLRKKEASPPSNKLCCSKGSKI

SEQ ID NO: 78218 - protein, 356 aa, Homo sapiens; identical to SEQ ID NO: 78217
  Payload ID: 15580
  Gene Symbol: SERTAD4
  Gene Name: SERTA domain containing 4
  Uniprot ID: Q9NUC0
  ENSP ID: ENSP00000486369

SEQ ID NO: 78219 - protein, 122 aa, Homo sapiens
  Payload ID: 15581
  Gene Symbol: SAA1
  Gene Name: serum amyloid A1
  Uniprot ID: P0DJI8
  ENSP ID: ENSP00000348918
MKLLTGLVFCSLVLGVSSRSFFSFLGEAFDGARDMWRAYSDMREANYIGSDKYFHARGNYDAAKRGPGGAWAAEVITDARENIQRFFGHGAEDSLADQAANEWGRSGKDPNHFRPAGLPEKY

SEQ ID NO: 78220 - protein, 122 aa, Homo sapiens; identical to SEQ ID NO: 78219
  Payload ID: 15581
  Gene Symbol: SAA1
  Gene Name: serum amyloid A1
  Uniprot ID: P0DJI8
  ENSP ID: ENSP00000384906

SEQ ID NO: 78221 - protein, 122 aa, Homo sapiens; identical to SEQ ID NO: 78219
  Payload ID: 15581
  Gene Symbol: SAA1
  Gene Name: serum amyloid A1
  ENSP ID: ENSP00000436866

SEQ ID NO: 78222 - protein, 122 aa, Homo sapiens
  Payload ID: 15582
  Gene Symbol: SAA2
  Gene Name: serum amyloid A2
  Uniprot ID: P0DJI9
  ENSP ID: ENSP00000256733
MKLLTGLVFCSLVLSVSSRSFFSFLGEAFDGARDMWRAYSDMREANYIGSDKYFHARGNYDAAKRGPGGAWAAEVISNARENIQRLTGRGAEDSLADQAANKWGRSGRDPNHFRPAGLPEKY

SEQ ID NO: 78223 - protein, 83 aa, Homo sapiens
  Payload ID: 15582
  Gene Symbol: SAA2
  Gene Name: serum amyloid A2
  Uniprot ID: P0DJI9
  ENSP ID: ENSP00000416716
MKLLTGLVFCSLVLSVSSRSFFSFLGEAFDGARDMWRAYSDMREANYIGSDKYFHARGNYDAAKRGPGGAWAAEVISLFSAEL

SEQ ID NO: 78224 - protein, 80 aa, Homo sapiens
  Payload ID: 15582
  Gene Symbol: SAA2
  Gene Name: serum amyloid A2
  ENSP ID: ENSP00000432370
MKLLTGLVFCSLVLSVSSRSFFSFLGEAFDGARDMWRAYSDMREANYIGSDKYFHARGNYDAAKRGPGGAWAAEVIREDD

SEQ ID NO: 78225 - protein, 113 aa, Homo sapiens
  Payload ID: 15582
  Gene Symbol: SAA2
  Gene Name: serum amyloid A2
  ENSP ID: ENSP00000435659
MKLLTGLVFCSLVLSVSSRSFFSFLGEAFDGARDMWRAYSDMREANYIGSDKYFHARGNYDAAKRGPGGAWAAEVIRLKCHGMIMAHCNLDLPGLKRSSHFSLLNNWDCRCAP

SEQ ID NO: 78226 - protein, 122 aa, Homo sapiens; identical to SEQ ID NO: 78222
  Payload ID: 15582
  Gene Symbol: SAA2
  Gene Name: serum amyloid A2
  Uniprot ID: P0DJI9
  ENSP ID: ENSP00000436126

SEQ ID NO: 78227 - protein, 122 aa, Homo sapiens; identical to SEQ ID NO: 78222
  Payload ID: 15582
  Gene Symbol: SAA2
  Gene Name: serum amyloid A2
  Uniprot ID: P0DJI9
  ENSP ID: ENSP00000437162

SEQ ID NO: 78228 - protein, 130 aa, Homo sapiens
  Payload ID: 15583
  Gene Symbol: SAA4
  Gene Name: serum amyloid A4, constitutive
  Uniprot ID: P35542
  ENSP ID: ENSP00000278222
MRLFTGIVFCSLVMGVTSESWRSFFKEALQGVGDMGRAYWDIMISNHQNSNRYLYARGNYDAAQRGPGGVWAAKLISRSRVYLQGLIDCYLFGNSSTVLEDSKSNEKAEEWGRSGKDPDRFRPDGLPKKY

SEQ ID NO: 78229 - protein, 473 aa, Homo sapiens
  Payload ID: 15584
  Gene Symbol: SAAL1
  Gene Name: serum amyloid A-like 1
  ENSP ID: ENSP00000300013
MDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 78230 - protein, 353 aa, Homo sapiens
  Payload ID: 15584
  Gene Symbol: SAAL1
  Gene Name: serum amyloid A-like 1
  ENSP ID: ENSP00000431160
MDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKGKSSSN

SEQ ID NO: 78231 - protein, 209 aa, Homo sapiens
  Payload ID: 15584
  Gene Symbol: SAAL1
  Gene Name: serum amyloid A-like 1
  ENSP ID: ENSP00000431489
MDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGCYCTVCMIQTHLLCWKQAEVASVWVERIQEHPAIYDSICFIMSSSTNVDLLVKVGEVVDKLFDLDEKLMLE

SEQ ID NO: 78232 - protein, 149 aa, Homo sapiens
  Payload ID: 15584
  Gene Symbol: SAAL1
  Gene Name: serum amyloid A-like 1
  ENSP ID: ENSP00000432044
LSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIGDGGSGSKGRPVEQTEVFLCISKPSSFL

SEQ ID NO: 78233 - protein, 476 aa, Homo sapiens
  Payload ID: 15584
  Gene Symbol: SAAL1
  Gene Name: serum amyloid A-like 1
  ENSP ID: ENSP00000432216
MDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKGKYNLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 78234 - protein, 474 aa, Homo sapiens
  Payload ID: 15584
  Gene Symbol: SAAL1
  Gene Name: serum amyloid A-like 1
  Uniprot ID: Q96ER3
  ENSP ID: ENSP00000432487
MDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKVDLPLIDSLIRVLQNMEQCQKKPENSAESNTEETKRTDLTQDDFHLKILKDILCEFLSNIFQALTKETVAQGVKEGQLSKQKCSSAFQNLLPFYSPVVEDFIKILREVDKALADDLEKNFPSLKVQT

SEQ ID NO: 78235 - protein, 133 aa, Homo sapiens
  Payload ID: 15584
  Gene Symbol: SAAL1
  Gene Name: serum amyloid A-like 1
  ENSP ID: ENSP00000433946
  MOD_RES (1)..(1): Any amino acid
XPPGRDKEEEEEVAGGDCIGSTVYSKHWLFGVLSGLIQIVSPENTKSSSDDEEQLTELDEEMENEICRALTKETVAQGVKEGQLSKQKCSSAFQNLLPFYSPVVEDFIKILREVDKALADDLEKNFPSLKVQT

SEQ ID NO: 78236 - protein, 264 aa, Homo sapiens
  Payload ID: 15584
  Gene Symbol: SAAL1
  Gene Name: serum amyloid A-like 1
  ENSP ID: ENSP00000436031
EICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQVRSENPEWLDVYMHILQLLTTVDDGIQAIVHCPDTGKDIWNLLFDLVCHEFCQSDDPPIILQEQKTVLASVFSVLSAIYASQTEQEYLKIEKGDGGSGSKGRPVEQTEVFLCISKPSSFL

SEQ ID NO: 78237 - protein, 425 aa, Homo sapiens
  Payload ID: 15585
  Gene Symbol: SDPR
  Gene Name: serum deprivation response
  Uniprot ID: O95810
  ENSP ID: ENSP00000305675
MGEDAAQAEKFQHPGSDMRQEKPSSPSPMPSSTPSPSLNLGNTEEAIRDNSQVNAVTVLTLLDKLVNMLDAVQENQHKMEQRQISLEGSVKGIQNDLTKLSKYQASTSNTVSKLLEKSRKVSAHTRAVKERMDRQCAQVKRLENNHAQLLRRNHFKVLIFQEENEIPASVFVKQPVSGAVEGKEELPDENKSLEETLHTVDLSSDDDLPHDEEALEDSAEEKVEESRAEKIKRSSLKKVDSLKKAFSRQNIEKKMNKLGTKIVSVERREKIKKSLTSNHQKISSGKSSPFKVSPLTFGRKKVREGESHAENETKSEDLPSSEQMPNDQEEESFAEGHSEASLASALVEGEIAEEAAEKATSRGSNSGMDSNIDLTIVEDEEEESVALEQAQKVRYEGSYALTSEEAERSDGDPVQPAVLQVHQTS

SEQ ID NO: 78238 - protein, 508 aa, Homo sapiens
  Payload ID: 15586
  Gene Symbol: SRF
  Gene Name: serum response factor
  Uniprot ID: P11831
  ENSP ID: ENSP00000265354
MLPTQAGAAAALGRGSALGGSLNRTPTGRPGGGGGTRGANGGRVPGNGAGLGPGRLEREAAAAAATTPAPTAGALYSGSEGDSESGEEEELGAERRGLKRSLSEMEIGMVVGGPEASAAATGGYGPVSGAVSGAKPGKKTRGRVKIKMEFIDNKLRRYTTFSKRKTGIMKKAYELSTLTGTQVLLLVASETGHVYTFATRKLQPMITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 78239 - protein, 429 aa, Homo sapiens
  Payload ID: 15587
  Gene Symbol: SRFBP1
  Gene Name: serum response factor binding protein 1
  Uniprot ID: Q8NEF9
  ENSP ID: ENSP00000341324
MAQPGTLNLNNEVVKMRKEVKRIRVLVIRKLVRSVGRLKSKKGTEDALLKNQRRAQRLLEEIHAMKELKPDIVTKSALGDDINFEKIFKKPDSTATERAIARLAVHPLLKKKIDVLKAAVQAFKEARQNVAEVESSKNASEDNHSENTLYSNDNGSNLQREATVISEQKVKETKILAKKPIHNSKEKIAKMEHGPKAVTIANSPSKPSEKDSVVSLESQKTPADPKLKTLSQTKKNKGSDSSLSGNSDGGEEFCEEEKEYFDDSTEERFYKQSSMSEDSDSGDDFFIGKVRRTRKKESSCHSSVKEQKPLEKVFLKEDTGETHGDTRNDKIKPSTETRKLESVFFHSLSGSKSSRRNFKEQAPKTRSLDFPQNEPQIKNQFNKKLSGRLENTKQQLQLPLHPSWEASRRRKEQQSNIAVFQGKKITFDD

SEQ ID NO: 78240 - protein, 431 aa, Homo sapiens
  Payload ID: 15588
  Gene Symbol: SGK1
  Gene Name: serum/glucocorticoid regulated kinase 1
  Uniprot ID: O00141
  ENSP ID: ENSP00000237305
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 78241 - protein, 421 aa, Homo sapiens
  Payload ID: 15588
  Gene Symbol: SGK1
  Gene Name: serum/glucocorticoid regulated kinase 1
  Uniprot ID: O00141
  ENSP ID: ENSP00000356831
MKPSKRFFISPPSSTAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 78242 - protein, 526 aa, Homo sapiens
  Payload ID: 15588
  Gene Symbol: SGK1
  Gene Name: serum/glucocorticoid regulated kinase 1
  Uniprot ID: O00141
  ENSP ID: ENSP00000356832
MVNKDMNGFPVKKCSAFQFFKKRVRRWIKSPMVSVDKHQSPSLKYTGSSMVHIPPGEPDFESSLCQTCLGEHAFQRGVLPQENESCSWETQSGCEVREPCNHANILTKPDPRTFWTNDDPAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 78243 - protein, 445 aa, Homo sapiens
  Payload ID: 15588
  Gene Symbol: SGK1
  Gene Name: serum/glucocorticoid regulated kinase 1
  Uniprot ID: O00141
  ENSP ID: ENSP00000396242
MGEMQGALARARLESLLRPRHKKRAEAQKRSESFLLSGLAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 78244 - protein, 55 aa, Homo sapiens
  Payload ID: 15588
  Gene Symbol: SGK1
  Gene Name: serum/glucocorticoid regulated kinase 1
  ENSP ID: ENSP00000431705
  MOD_RES (1)..(1): Any amino acid
XPPGEPDFESSLCQTCLGEHAFQRGVLPQENESCSWETQSGCEILCKTSGQLTSP

SEQ ID NO: 78245 - protein, 387 aa, Homo sapiens
  Payload ID: 15588
  Gene Symbol: SGK1
  Gene Name: serum/glucocorticoid regulated kinase 1
  ENSP ID: ENSP00000434302
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 78246 - protein, 459 aa, Homo sapiens
  Payload ID: 15588
  Gene Symbol: SGK1
  Gene Name: serum/glucocorticoid regulated kinase 1
  Uniprot ID: O00141
  ENSP ID: ENSP00000434450
MSSQSSSLSEACSREAYSSHNWALPPASRSNPQPAYPWATRRMKEEAIKPPLKAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 78247 - protein, 144 aa, Homo sapiens
  Payload ID: 15588
  Gene Symbol: SGK1
  Gene Name: serum/glucocorticoid regulated kinase 1
  ENSP ID: ENSP00000435577
MVSVDKHQSPSLKYTGSSMVHIPPGEPDFESSLCQTCLGEHAFQRGVLPQENESCSWETQSGCEVREPCNHANILTKPDPRTFWTNDDPAFMKQRRMGLNDFIQKIANNSYACKHPEVQSILKISQPQEPELMNANPSPPPSPS

SEQ ID NO: 78248 - protein, 153 aa, Homo sapiens
  Payload ID: 15588
  Gene Symbol: SGK1
  Gene Name: serum/glucocorticoid regulated kinase 1
  ENSP ID: ENSP00000435724
MVNKDMNGFPVKKCSAFQFFKKRVRRWIKSPMVSVDKHQSPSLKYTGSSMVHIPPGEPDFESSLCQTCLGEHAFQRGVLPQENESCSWETQSGCEVSSCSLWIYSPGKILGLCFSCISARVYPKNNFLMHIYKASEEDLELWSLLAHYVIFLK

SEQ ID NO: 78249 - protein, 60 aa, Homo sapiens
  Payload ID: 15588
  Gene Symbol: SGK1
  Gene Name: serum/glucocorticoid regulated kinase 1
  ENSP ID: ENSP00000436470
MVNKDMNGFPVKKCSAFQFFKKRVRRWIKSPMVSVDKHQSPSLKYTGSSMVHIPPGEPDF

SEQ ID NO: 78250 - protein, 427 aa, Homo sapiens
  Payload ID: 15589
  Gene Symbol: SGK2
  Gene Name: serum/glucocorticoid regulated kinase 2
  Uniprot ID: Q9HBY8
  ENSP ID: ENSP00000340608
MQGLLTSGRKPSGGGRCTGRGGWRGQWCLKPWMGGADPPTPTLSCLLLPVPPELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 78251 - protein, 358 aa, Homo sapiens
  Payload ID: 15589
  Gene Symbol: SGK2
  Gene Name: serum/glucocorticoid regulated kinase 2
  ENSP ID: ENSP00000362168
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVDTLGPGTRKASFRWDFKKTVKIMSNLYPGERTIHGILGRDEWTLE

SEQ ID NO: 78252 - protein, 367 aa, Homo sapiens
  Payload ID: 15589
  Gene Symbol: SGK2
  Gene Name: serum/glucocorticoid regulated kinase 2
  Uniprot ID: Q9HBY8
  ENSP ID: ENSP00000362184
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 78253 - protein, 367 aa, Homo sapiens; identical to SEQ ID NO: 78252
  Payload ID: 15589
  Gene Symbol: SGK2
  Gene Name: serum/glucocorticoid regulated kinase 2
  Uniprot ID: Q9HBY8
  ENSP ID: ENSP00000362192

SEQ ID NO: 78254 - protein, 367 aa, Homo sapiens; identical to SEQ ID NO: 78252
  Payload ID: 15589
  Gene Symbol: SGK2
  Gene Name: serum/glucocorticoid regulated kinase 2
  Uniprot ID: Q9HBY8
  ENSP ID: ENSP00000392795

SEQ ID NO: 78255 - protein, 198 aa, Homo sapiens
  Payload ID: 15589
  Gene Symbol: SGK2
  Gene Name: serum/glucocorticoid regulated kinase 2
  ENSP ID: ENSP00000396222
MNSSPAGTPSPQPSRANGNINLGPSANPNAQPTDFDFLKVIGKGNYGKVLLAKRKSDGAFYAVKVLQKKSILKKKESHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPE

SEQ ID NO: 78256 - protein, 393 aa, Homo sapiens
  Payload ID: 15589
  Gene Symbol: SGK2
  Gene Name: serum/glucocorticoid regulated kinase 2
  Uniprot ID: Q9HBY8
  ENSP ID: ENSP00000412214
MQGLLTSGRKPSGGGRCTELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 78257 - protein, 285 aa, Homo sapiens
  Payload ID: 15589
  Gene Symbol: SGK2
  Gene Name: serum/glucocorticoid regulated kinase 2
  ENSP ID: ENSP00000436841
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFVA

SEQ ID NO: 78258 - protein, 10 aa, Homo sapiens
  Payload ID: 15589
  Gene Symbol: SGK2
  Gene Name: serum/glucocorticoid regulated kinase 2
  ENSP ID: ENSP00000481432
MNSSPAGTPS

SEQ ID NO: 78259 - protein, 496 aa, Homo sapiens; identical to SEQ ID NO: 10263
  Payload ID: 15590
  Gene Symbol: SGK3
  Gene Name: serum/glucocorticoid regulated kinase family, member 3
  Uniprot ID: Q96BR1
  ENSP ID: ENSP00000331816

SEQ ID NO: 78260 - protein, 496 aa, Homo sapiens; identical to SEQ ID NO: 10263
  Payload ID: 15590
  Gene Symbol: SGK3
  Gene Name: serum/glucocorticoid regulated kinase family, member 3
  Uniprot ID: Q96BR1
  ENSP ID: ENSP00000379842

SEQ ID NO: 78261 - protein, 126 aa, Homo sapiens
  Payload ID: 15590
  Gene Symbol: SGK3
  Gene Name: serum/glucocorticoid regulated kinase family, member 3
  ENSP ID: ENSP00000428529
MDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVN

SEQ ID NO: 78262 - protein, 128 aa, Homo sapiens
  Payload ID: 15590
  Gene Symbol: SGK3
  Gene Name: serum/glucocorticoid regulated kinase family, member 3
  ENSP ID: ENSP00000428972
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDP

SEQ ID NO: 78263 - protein, 166 aa, Homo sapiens
  Payload ID: 15590
  Gene Symbol: SGK3
  Gene Name: serum/glucocorticoid regulated kinase family, member 3
  ENSP ID: ENSP00000429565
MALKIPAKRIFGDNFDPDFIKQRRAGLNEFIQNLVRYPELYNHPDVRAFLQMDSPKHQSDPSEDEDERSSQKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAE

SEQ ID NO: 78264 - protein, 149 aa, Homo sapiens
  Payload ID: 15590
  Gene Symbol: SGK3
  Gene Name: serum/glucocorticoid regulated kinase family, member 3
  ENSP ID: ENSP00000429606
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKVLLAKRKLDG

SEQ ID NO: 78265 - protein, 496 aa, Homo sapiens; identical to SEQ ID NO: 10263
  Payload ID: 15590
  Gene Symbol: SGK3
  Gene Name: serum/glucocorticoid regulated kinase family, member 3
  Uniprot ID: Q96BR1
  ENSP ID: ENSP00000430256

SEQ ID NO: 78266 - protein, 496 aa, Homo sapiens; identical to SEQ ID NO: 10263
  Payload ID: 15590
  Gene Symbol: SGK3
  Gene Name: serum/glucocorticoid regulated kinase family, member 3
  Uniprot ID: Q96BR1
  ENSP ID: ENSP00000430463

SEQ ID NO: 78267 - protein, 108 aa, Homo sapiens
  Payload ID: 15590
  Gene Symbol: SGK3
  Gene Name: serum/glucocorticoid regulated kinase family, member 3
  ENSP ID: ENSP00000430475
MALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGK

SEQ ID NO: 78268 - protein, 464 aa, Homo sapiens
  Payload ID: 15590
  Gene Symbol: SGK3
  Gene Name: serum/glucocorticoid regulated kinase family, member 3
  Uniprot ID: Q96BR1
  ENSP ID: ENSP00000430691
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 78269 - protein, 514 aa, Homo sapiens
  Payload ID: 15591
  Gene Symbol: SARS
  Gene Name: seryl-tRNA synthetase
  Uniprot ID: P49591
  ENSP ID: ENSP00000234677
MVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 78270 - protein, 536 aa, Homo sapiens
  Payload ID: 15591
  Gene Symbol: SARS
  Gene Name: seryl-tRNA synthetase
  ENSP ID: ENSP00000358939
MVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKRKNNLHLSTQNKLEASLFSPKKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 78271 - protein, 518 aa, Homo sapiens
  Payload ID: 15592
  Gene Symbol: SARS2
  Gene Name: seryl-tRNA synthetase 2, mitochondrial
  Uniprot ID: Q9NP81
  ENSP ID: ENSP00000221431
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 78272 - protein, 518 aa, Homo sapiens
  Payload ID: 15592
  Gene Symbol: SARS2
  Gene Name: seryl-tRNA synthetase 2, mitochondrial
  ENSP ID: ENSP00000406754
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKAGMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 78273 - protein, 236 aa, Homo sapiens
  Payload ID: 15592
  Gene Symbol: SARS2
  Gene Name: seryl-tRNA synthetase 2, mitochondrial
  ENSP ID: ENSP00000414954
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPGACPTCLATGPITCAGLEPSCSTAWSTSHSTSFSAGASPP

SEQ ID NO: 78274 - protein, 187 aa, Homo sapiens
  Payload ID: 15592
  Gene Symbol: SARS2
  Gene Name: seryl-tRNA synthetase 2, mitochondrial
  ENSP ID: ENSP00000468865
MFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPALHARAPGPRGPPLLCPCCLRVSH

SEQ ID NO: 78275 - protein, 90 aa, Homo sapiens
  Payload ID: 15592
  Gene Symbol: SARS2
  Gene Name: seryl-tRNA synthetase 2, mitochondrial
  ENSP ID: ENSP00000471767
MAASMARRLWPLLTRRGFRPRGGCISNDSPRRSFTTEKRNRNLLYEYAREGYSALPQLDIERFCACPEEAAHALELRKGELRSADLPAIA

SEQ ID NO: 78276 - protein, 328 aa, Homo sapiens
  Payload ID: 15592
  Gene Symbol: SARS2
  Gene Name: seryl-tRNA synthetase 2, mitochondrial
  ENSP ID: ENSP00000472339
MVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 78277 - protein, 135 aa, Homo sapiens
  Payload ID: 15592
  Gene Symbol: SARS2
  Gene Name: seryl-tRNA synthetase 2, mitochondrial
  ENSP ID: ENSP00000472576
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQGGPA

SEQ ID NO: 78278 - protein, 520 aa, Homo sapiens
  Payload ID: 15592
  Gene Symbol: SARS2
  Gene Name: seryl-tRNA synthetase 2, mitochondrial
  Uniprot ID: Q9NP81
  ENSP ID: ENSP00000472847
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQVRLDPGAGSIFGPTFLPFPGQLSLLVEAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 78279 - protein, 135 aa, Homo sapiens; identical to SEQ ID NO: 78277
  Payload ID: 15592
  Gene Symbol: SARS2
  Gene Name: Seryl-tRNA synthetase 2, mitochondrial
  ENSP ID: ENSP00000488935

SEQ ID NO: 78280 - protein, 518 aa, Homo sapiens; identical to SEQ ID NO: 78272
  Payload ID: 15592
  Gene Symbol: SARS2
  Gene Name: Seryl-tRNA synthetase 2, mitochondrial
  ENSP ID: ENSP00000488985

SEQ ID NO: 78281 - protein, 187 aa, Homo sapiens; identical to SEQ ID NO: 78274
  Payload ID: 15592
  Gene Symbol: SARS2
  Gene Name: Seryl-tRNA synthetase 2, mitochondrial
  ENSP ID: ENSP00000489303

SEQ ID NO: 78282 - protein, 328 aa, Homo sapiens; identical to SEQ ID NO: 78276
  Payload ID: 15592
  Gene Symbol: SARS2
  Gene Name: Seryl-tRNA synthetase 2, mitochondrial
  ENSP ID: ENSP00000489392

SEQ ID NO: 78283 - protein, 90 aa, Homo sapiens; identical to SEQ ID NO: 78275
  Payload ID: 15592
  Gene Symbol: SARS2
  Gene Name: Seryl-tRNA synthetase 2, mitochondrial
  ENSP ID: ENSP00000489404

SEQ ID NO: 78284 - protein, 520 aa, Homo sapiens; identical to SEQ ID NO: 78278
  Payload ID: 15592
  Gene Symbol: SARS2
  Gene Name: Seryl-tRNA synthetase 2, mitochondrial
  ENSP ID: ENSP00000489453

SEQ ID NO: 78285 - protein, 236 aa, Homo sapiens; identical to SEQ ID NO: 78273
  Payload ID: 15592
  Gene Symbol: SARS2
  Gene Name: Seryl-tRNA synthetase 2, mitochondrial
  ENSP ID: ENSP00000489522

SEQ ID NO: 78286 - protein, 518 aa, Homo sapiens; identical to SEQ ID NO: 78271
  Payload ID: 15592
  Gene Symbol: SARS2
  Gene Name: Seryl-tRNA synthetase 2, mitochondrial
  ENSP ID: ENSP00000489539

SEQ ID NO: 78287 - protein, 426 aa, Homo sapiens
  Payload ID: 15593
  Gene Symbol: SESN1
  Gene Name: sestrin 1
  Uniprot ID: Q9Y6P5
  ENSP ID: ENSP00000306734
MHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 78288 - protein, 492 aa, Homo sapiens
  Payload ID: 15593
  Gene Symbol: SESN1
  Gene Name: sestrin 1
  Uniprot ID: Q9Y6P5
  ENSP ID: ENSP00000349061
MRLAAAANEAYTAPLAVSGLLGCKQCGGGRDQDEELGIRIPRPLGQGPSRFIPEKEILQVGSEDAQMHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 78289 - protein, 551 aa, Homo sapiens
  Payload ID: 15593
  Gene Symbol: SESN1
  Gene Name: sestrin 1
  Uniprot ID: Q9Y6P5
  ENSP ID: ENSP00000393762
MAEGENEVRWDGLCSRDSTTRETALENIRQTILRKTEYLRSVKETPHRPSDGLSNTESSDGLNKLLAHLLMLSKRCPFKDVREKSEFILKSIQELGIRIPRPLGQGPSRFIPEKEILQVGSEDAQMHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 78290 - protein, 480 aa, Homo sapiens
  Payload ID: 15594
  Gene Symbol: SESN2
  Gene Name: sestrin 2
  Uniprot ID: P58004
  ENSP ID: ENSP00000253063
MIVADSECRAELKDYLRFAPGGVGDSGPGEEQRESRARRGPRGPSAFIPVEEVLREGAESLEQHLGLEALMSSGRVDNLAVVMGLHPDYFTSFWRLHYLLLHTDGPLASSWRHYIAIMAAARHQCSYLVGSHMAEFLQTGGDPEWLLGLHRAPEKLRKLSEINKLLAHRPWLITKEHIQALLKTGEHTWSLAELIQALVLLTHCHSLSSFVFGCGILPEGDADGSPAPQAPTPPSEQSSPPSRDPLNNSGGFESARDVEALMERMQQLQESLLRDEGTSQEEMESRFELEKSESLLVTPSADILEPSPHPDMLCFVEDPTFGYEDFTRRGAQAPPTFRAQDYTWEDHGYSLIQRLYPEGGQLLDEKFQAAYSLTYNTIAMHSGVDTSVLRRAIWNYIHCVFGIRYDDYDYGEVNQLLERNLKVYIKTVACYPEKTTRRMYNLFWRHFRHSEKVHVNLLLLEARMQAALLYALRAITRYMT

SEQ ID NO: 78291 - protein, 353 aa, Homo sapiens
  Payload ID: 15595
  Gene Symbol: SESN3
  Gene Name: sestrin 3
  Uniprot ID: P58005
  ENSP ID: ENSP00000278499
MSLHTQYLESFLRSQFYMLRMDGPLPLPYRHYIAIMKLVKTGENNWSLPELVHAVVLLAHYHALASFVFGSGINPERDPEISNGFRLISVNNFCVCDLANDNNIENASLSGSNFGIVDSLSELEALMERMKRLQEEREDEEASQEEMSTRFEKEKKESLFVVSGDTFHSFPHSDFEDDMIITSDVSRYIEDPGFGYEDFARRGEEHLPTFRAQDYTWENHGFSLVNRLYSDIGHLLDEKFRMVYNLTYNTMATHEDVDTTMLRRALFNYVHCMFGIRYDDYDYGEVNQLLERSLKVYIKTVTCYPERTTKRMYDSYWRQFKHSEKVHVNLLLMEARMQAELLYALRAITRHLT

SEQ ID NO: 78292 - protein, 321 aa, Homo sapiens
  Payload ID: 15595
  Gene Symbol: SESN3
  Gene Name: sestrin 3
  Uniprot ID: P58005
  ENSP ID: ENSP00000407008
MNRGGGSPSAAANYLLCTNCRKVLRKDKRIRVSQPLTRGPSAFIPEKEVVQANTVDERTNFLVEEYSTSGRLDNITQVMSLHTQYLESFLRSQFYMLRMDGPLPLPYRHYIAIMAAARHQCSYLINMHVDEFLKTGGIAEWLNGLEYVPQRLKNLNEINKLLAHRPWLITKEHIQKLVKTGENNWSLPELVHAVVLLAHYHALASFVFGSGINPERDPEISNGFRLISVNNFCVCDLANDNNIENASLSGSNFGIVDSLSELEALMERMKRLQEEREDEEASQEEMSTRFEKEKKESLFVVSGDTFHSFPHSGAFLHFFAF

SEQ ID NO: 78293 - protein, 70 aa, Homo sapiens
  Payload ID: 15595
  Gene Symbol: SESN3
  Gene Name: sestrin 3
  ENSP ID: ENSP00000439580
MDKDKRIRVSQPLTRGPSAFIPEKEVVQANTVDERTNFLVEEYSTSGRLDNITQVMSLHTQYLESFLRSQ

SEQ ID NO: 78294 - protein, 492 aa, Homo sapiens
  Payload ID: 15595
  Gene Symbol: SESN3
  Gene Name: sestrin 3
  Uniprot ID: P58005
  ENSP ID: ENSP00000441927
MNRGGGSPSAAANYLLCTNCRKVLRKDKRIRVSQPLTRGPSAFIPEKEVVQANTVDERTNFLVEEYSTSGRLDNITQVMSLHTQYLESFLRSQFYMLRMDGPLPLPYRHYIAIMAAARHQCSYLINMHVDEFLKTGGIAEWLNGLEYVPQRLKNLNEINKLLAHRPWLITKEHIQKLVKTGENNWSLPELVHAVVLLAHYHALASFVFGSGINPERDPEISNGFRLISVNNFCVCDLANDNNIENASLSGSNFGIVDSLSELEALMERMKRLQEEREDEEASQEEMSTRFEKEKKESLFVVSGDTFHSFPHSDFEDDMIITSDVSRYIEDPGFGYEDFARRGEEHLPTFRAQDYTWENHGFSLVNRLYSDIGHLLDEKFRMVYNLTYNTMATHEDVDTTMLRRALFNYVHCMFGIRYDDYDYGEVNQLLERSLKVYIKTVTCYPERTTKRMYDSYWRQFKHSEKVHVNLLLMEARMQAELLYALRAITRHLT

SEQ ID NO: 78295 - protein, 83 aa, Homo sapiens
  Payload ID: 15595
  Gene Symbol: SESN3
  Gene Name: sestrin 3
  ENSP ID: ENSP00000489281
MSLHTQYLESFLRSQFYMLRMDGPLPLPYRHYIAIMAAARHQCSYLINMHVDEFLKTGGIAEWLNGLEYVPQRLKNLNEINKL

SEQ ID NO: 78296 - protein, 103 aa, Homo sapiens
  Payload ID: 15596
  Gene Symbol: SMYD1
  Gene Name: SET and MYND domain containing 1
  ENSP ID: ENSP00000387482
MTIGRMENVEVFTAEGKGRGLKATKEFWAADIIFAERAYSAVVFDSLVNFVCHTCFKRQEKLHRCGQCKFAHYCDRTCQKDAWLNHKNECSAIKRYGKVLQED

SEQ ID NO: 78297 - protein, 490 aa, Homo sapiens
  Payload ID: 15596
  Gene Symbol: SMYD1
  Gene Name: SET and MYND domain containing 1
  Uniprot ID: Q8NB12
  ENSP ID: ENSP00000393453
MTIGRMENVEVFTAEGKGRGLKATKEFWAADIIFAERAYSAVVFDSLVNFVCHTCFKRQEKLHRCGQCKFAHYCDRTCQKDAWLNHKNECSAIKRYGKVPNENIRLAARIMWRVEREGTGLTEGCLVSVDDLQNHVEHFGEEEQKDLRVDVDTFLQYWPPQSQQFSMQYISHIFGVINCNGFTLSDQRGLQAVGVGIFPNLGLVNHDCWPNCTVIFNNGNHEAVKSMFHTQMRIELRALGKISEGEELTVSYIDFLNVSEERKRQLKKQYYFDCTCEHCQKKLKDDLFLGVKDNPKPSQEVVKEMIQFSKDTLEKIDKARSEGLYHEVVKLCRECLEKQEPVFADTNIYMLRMLSIVSEVLSYLQAFEEASFYARRMVDGYMKLYHPNNAQLGMAVMRAGLTNWHAGNIEVGHGMICKAYAILLVTHGPSHPITKDLEAMRVQTEMELRMFRQNEFMYYKMREAALNNQPMQVMAEPSNEPSPALFHKKQ

SEQ ID NO: 78298 - protein, 477 aa, Homo sapiens
  Payload ID: 15596
  Gene Symbol: SMYD1
  Gene Name: SET and MYND domain containing 1
  ENSP ID: ENSP00000407888
MTIGRMENVEVFTAEGKGRGLKATKEFWAADIIFAERAYSAVVFDSLVNFVCHTCFKRQEKLHRCGQCKFAHYCDRTCQKDAWLNHKNECSAIKRYGKVPNENIRLAARIMWRVEREGTGLTEGCLVSVDDLQNHVEHFGEEEQKDLRVDVDTFLQYWPPQSQQFSMQYISHIFGVINCNGFTLSDQRGLQAVGVGIFPNLGLVNHDCWPNCTVIFNNGKIELRALGKISEGEELTVSYIDFLNVSEERKRQLKKQYYFDCTCEHCQKKLKDDLFLGVKDNPKPSQEVVKEMIQFSKDTLEKIDKARSEGLYHEVVKLCRECLEKQEPVFADTNIYMLRMLSIVSEVLSYLQAFEEASFYARRMVDGYMKLYHPNNAQLGMAVMRAGLTNWHAGNIEVGHGMICKAYAILLVTHGPSHPITKDLEAMRVQTEMELRMFRQNEFMYYKMREAALNNQPMQVMAEPSNEPSPALFHKKQ

SEQ ID NO: 78299 - protein, 433 aa, Homo sapiens
  Payload ID: 15597
  Gene Symbol: SMYD2
  Gene Name: SET and MYND domain containing 2
  Uniprot ID: Q9NRG4
  ENSP ID: ENSP00000355924
MRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLGFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKAIAIMEVAHGKDHPYISEIKQEIESH

SEQ ID NO: 78300 - protein, 98 aa, Homo sapiens
  Payload ID: 15597
  Gene Symbol: SMYD2
  Gene Name: SET and MYND domain containing 2
  ENSP ID: ENSP00000409822
LSDPPKAEAIRDMVRYARNVIEEFRRAKHYKSPSELLEICELSQEKMSSVFEDSNVYMLHMMYQAMGVCLYMQDWEGALQYGQKIIKPYSLGHCNHGS

SEQ ID NO: 78301 - protein, 147 aa, Homo sapiens
  Payload ID: 15598
  Gene Symbol: SMYD3
  Gene Name: SET and MYND domain containing 3
  ENSP ID: ENSP00000375712
MQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMD

SEQ ID NO: 78302 - protein, 182 aa, Homo sapiens
  Payload ID: 15598
  Gene Symbol: SMYD3
  Gene Name: SET and MYND domain containing 3
  ENSP ID: ENSP00000385380
MEPLKVEKFATAKRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKPIGMK

SEQ ID NO: 78303 - protein, 74 aa, Homo sapiens
  Payload ID: 15598
  Gene Symbol: SMYD3
  Gene Name: SET and MYND domain containing 3
  ENSP ID: ENSP00000394281
MRCSQCRVAKYCSAKCQKKAWPDHKRECKCLKSCKPRYPPDSVRLLGRVVFKLMDGAPSESEKLYSFYDLESNI

SEQ ID NO: 78304 - protein, 131 aa, Homo sapiens
  Payload ID: 15598
  Gene Symbol: SMYD3
  Gene Name: SET and MYND domain containing 3
  ENSP ID: ENSP00000408122
MRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEM

SEQ ID NO: 78305 - protein, 428 aa, Homo sapiens
  Payload ID: 15598
  Gene Symbol: SMYD3
  Gene Name: SET and MYND domain containing 3
  Uniprot ID: Q9H7B4
  ENSP ID: ENSP00000419184
MEPLKVEKFATAKRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 78306 - protein, 369 aa, Homo sapiens
  Payload ID: 15598
  Gene Symbol: SMYD3
  Gene Name: SET and MYND domain containing 3
  Uniprot ID: Q9H7B4
  ENSP ID: ENSP00000487434
MRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 78307 - protein, 804 aa, Homo sapiens
  Payload ID: 15599
  Gene Symbol: SMYD4
  Gene Name: SET and MYND domain containing 4
  Uniprot ID: Q8IYR2
  ENSP ID: ENSP00000304360
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYETCLKDINRAQTHGYPERLQPKIMLRKAECLVALGRLQEASQTISDLERNFTATPALADVLPQTLQRNLHRLKMKMQEKDSLTESFPAALAKTLEDAALREENEQLSNASSSIGLCVDPLKGRCLVATKDILPGELLVQEDAFVSVLNPGELPPPHHGLDSKWDTRVTNGDLYCHRCLKHTLATVPCDGCSYAKYCSQECLQQAWELYHRTECPLGGLLLTLGVFCHIALRLTLLVGFEDVRKIITKLCDKISNKDICLPESNNQVKTLNYGLGESEKNGNIVETPIPGCDINGKYENNYNAVFNLLPHTENHSPEHKFLCALCVSALCRQLEAASLQAIPTERIVNSSQLKAAVTPELCPDVTIWGVAMLRHMLQLQCNAQAMTTIQHTGPKGSIVTDSRQVRLATGIFPVISLLNHSCSPNTSVSFISTVATIRASQRIRKGQEILHCYGPHKSRMGVAERQQKLRSQYFFDCACPACQTEAHRMAAGPRWEAFCCNSCGAPMQGDDVLRCGSRSCAESAVSRDHLVSRLQDLQQQVRVAQKLLRDGELERAVQRLSGCQRDAESFLWAEHAVVGEIADGLARACAALGDWQKSATHLQRSLYVVEVRHGPSSVEMGHELFKLAQIFFNGFAVPEALSTIQKAEEVLSLHCGPWDDEIQELQKMKSCLLDLPPTPVGPAL

SEQ ID NO: 78308 - protein, 72 aa, Homo sapiens
  Payload ID: 15599
  Gene Symbol: SMYD4
  Gene Name: SET and MYND domain containing 4
  ENSP ID: ENSP00000459129
MDLPVDEWKSYLLQKWASLPTSVQVTISTAETLRDIFLHSSSLLQLECDGAISAHCNLHLPGSSDSRASASQ

SEQ ID NO: 78309 - protein, 223 aa, Homo sapiens
  Payload ID: 15599
  Gene Symbol: SMYD4
  Gene Name: SET and MYND domain containing 4
  ENSP ID: ENSP00000459819
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYETCLKDINRAQTHGYPERLQPKIMLRKAECLVALGRLQEASQTISDLERNFTATPALADVLPQTLQRNLHRLKMKMQEKDSLTESFPAALAKTLEDAALRE

SEQ ID NO: 78310 - protein, 558 aa, Homo sapiens
  Payload ID: 15599
  Gene Symbol: SMYD4
  Gene Name: SET and MYND domain containing 4
  ENSP ID: ENSP00000460921
KMQEKDSLTESFPAALAKTLEDAALREENEQLSNASSSIGLCVDPLKGRCLVATKDILPGELLVQEDAFVSVLNPGELPPPHHGLDSKWDTRVTNGDLYCHRCLKHTLATVPCDGCSYAKYCSQECLQQAWELYHRTECPLGGLLLTLGVFCHIALRLTLLVGFEDVRKIITKLCDKISNKDICLPESNNQVKTLNYGLGESEKNGNIVETPIPGCDINGKYENNYNAVFNLLPHTENHSPEHKFLCALCVSALCRQLEAASLQAIPTERIVNSSQLKAAVTPELCPDVTIWGVAMLRHMLQLQCNAQAMTTIQHTGPKGSIVTDSRQVRLATGIFPVISLLNHSCSPNTSVSFISTVATIRASQRIRKGQEILHCYGPHKSRMGVAERQQKLRSQYFFDCACPACQTEAHRMAAGPRWEAFCCNSCGAPMQGDDVLRCGSRSCAESAVSRDHLVSRLQDLQQQVRVAQKLLRDGELERAVQRLSGCQRDAESFLWAEHAVVGEIADGLARACAALGDWQKSATHLQRSLYVVEVRHGPSSVEMGHELFKLAQIFFNG

SEQ ID NO: 78311 - protein, 177 aa, Homo sapiens
  Payload ID: 15599
  Gene Symbol: SMYD4
  Gene Name: SET and MYND domain containing 4
  ENSP ID: ENSP00000461089
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYETCLKDINRAQTHGYPERLQPKIMLRKAECLVALGRLQEASQTISDLERNFTATP

SEQ ID NO: 78312 - protein, 1868 aa, Homo sapiens
  Payload ID: 15600
  Gene Symbol: SBF1
  Gene Name: SET binding factor 1
  ENSP ID: ENSP00000252027
MARLADYFVLVAFGPHPRGSGEGQGQILQRFPEKDWEDNPFPQGIELFCQPSGWQLCPERNPPTFFVAVLTDINSERHYCACLTFWEPAEPSQQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 78313 - protein, 1893 aa, Homo sapiens
  Payload ID: 15600
  Gene Symbol: SBF1
  Gene Name: SET binding factor 1
  Uniprot ID: O95248
  ENSP ID: ENSP00000370196
MARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 78314 - protein, 415 aa, Homo sapiens
  Payload ID: 15600
  Gene Symbol: SBF1
  Gene Name: SET binding factor 1
  ENSP ID: ENSP00000401538
  MOD_RES (1)..(1): Any amino acid
XFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 78315 - protein, 1849 aa, Homo sapiens
  Payload ID: 15601
  Gene Symbol: SBF2
  Gene Name: SET binding factor 2
  Uniprot ID: Q86WG5
  ENSP ID: ENSP00000256190
MARLADYFIVVGYDHEKPGSGEGLGKIIQRFPQKDWDDTPFPQGIELFCQPGGWQLSRERKQPTFFVVVLTDIDSDRHYCSCLTFYEAEINLQGTKKEEIEGEAKVSGLIQPAEVFAPKSLVLVSRLYYPEIFRACLGLIYTVYVDSLNVSLESLIANLCACLVPAAGGSQKLFSLGAGDRQLIQTPLHDSLPITGTSVALLFQQLGIQNVLSLFCAVLTENKVLFHSASFQRLSDACRALESLMFPLKYSYPYIPILPAQLLEVLSSPTPFIIGVHSVFKTDVHELLDVIIADLDGGTIKIPECIHLSSLPEPLLHQTQSALSLILHPDLEVADHAFPPPRTALSHSKMLDKEVRAVFLRLFAQLFQGYRSCLQLIRIHAEPVIHFHKTAFLGQRGLVENDFLTKVLSGMAFAGFVSERGPPYRSCDLFDELVAFEVERIKVEENNPVKMIKHVRELAEQLFKNENPNPHMAFQKVPRPTEGSHLRVHILPFPEINEARVQELIQENVAKNQNAPPATRIEKKCVVPAGPPVVSIMDKVTTVFNSAQRLEVVRNCISFIFENKILETEKTLPAALRALKGKAARQCLTDELGLHVQQNRAILDHQQFDYIIRMMNCTLQDCSSLEEYNIAAALLPLTSAFYRKLAPGVSQFAYTCVQDHPIWTNQQFWETTFYNAVQEQVRSLYLSAKEDNHAPHLKQKDKLPDDHYQEKTAMDLAAEQLRLWPTLSKSTQQELVQHEESTVFSQAIHFANLMVNLLVPLDTSKNKLLRTSAPGDWESGSNSIVTNSIAGSVAESYDTESGFEDSENTDIANSVVRFITRFIDKVCTESGVTQDHIKSLHCMIPGIVAMHIETLEAVHRESRRLPPIQKPKILRPALLPGEEIVCEGLRVLLDPDGREEATGGLLGGPQLLPAEGALFLTTYRILFRGTPHDQLVGEQTVVRSFPIASITKEKKITMQNQLQQNMQEGLQITSASFQLIKVAFDEEVSPEVVEIFKKQLMKFRYPQSIFSTFAFAAGQTTPQIILPKQKEKNTSFRTFSKTIVKGAKRAGKMTIGRQYLLKKKTGTIVEERVNRPGWNEDDDVSVSDESELPTSTTLKASEKSTMEQLVEKACFRDYQRLGLGTISGSSSRSRPEYFRITASNRMYSLCRSYPGLLVVPQAVQDSSLPRVARCYRHNRLPVVCWKNSRSGTLLLRSGGFHGKGVVGLFKSQNSPQAAPTSSLESSSSIEQEKYLQALLNAVSVHQKLRGNSTLTVRPAFALSPGVWASLRSSTRLISSPTSFIDVGARLAGKDHSASFSNSSYLQNQLLKRQAALYIFGEKSQLRNFKVEFALNCEFVPVEFHEIRQVKASFKKLMRACIPSTIPTDSEVTFLKALGDSEWFPQLHRIMQLAVVVSEVLENGSSVLVCLEEGWDITAQVTSLVQLLSDPFYRTLEGFQMLVEKEWLSFGHKFSQRSSLTLNCQGSGFAPVFLQFLDCVHQVHNQYPTEFEFNLYYLKFLAFHYVSNRFKTFLLDSDYERLEHGTLFDDKGEKHAKKGVCIWECIDRMHKRSPIFFNYLYSPLEIEALKPNVNVSSLKKWDYYIEETLSTGPSYDWMMLTPKHFPSEDSDLAGEAGPRSQRRTVWPCYDDVSCTQPDALTSLFSEIEKLEHKLNQAPEKWQQLWERVTVDLKEEPRTDRSQRHLSRSPGIVSTNLPSYQKRSLLHLPDSSMGEEQNSSISPSNGVERRAATLYSQYTSKNDENRSFEGTLYKRGALLKGWKPRWFVLDVTKHQLRYYDSGEDTSCKGHIDLAEVEMVIPAGPSMGAPKHTSDKAFFDLKTSKRVYNFCAQDGQSAQQWMDKIQSCISDA

SEQ ID NO: 78316 - protein, 396 aa, Homo sapiens
  Payload ID: 15601
  Gene Symbol: SBF2
  Gene Name: SET binding factor 2
  ENSP ID: ENSP00000410478
  MOD_RES (1)..(1): Any amino acid
XDKEVRAVFLRLFAQLFQGYRSCLQLIRIHAEPVIHFHKLVAFEVERIKVEENNPVKMIKHVRELAEQLFKNENPNPHMAFQKVPRPTEGSHLRVHILPFPEINEARVQELIQENVAKNQNAPPATRIEKKCVVPAGPPVVSIMDKVTTVFNSAQRLEVVRNCISFIFENKILETEKTLPAALRALKGKAARQCLTDELGLHVQQNRAILDHQQFDYIIRMMNCTLQDCSSLEEYNIAAALLPLTSAFYRKLAPGVSQFAYTCVQDHPIWTNQQFWETTFYNAVQEQVRSLYLSAKEDNHAPHLKQKDKLPDDHYQEKTAMDLAAEQLRLWPTLSKSTQQELVQHEESTVFSQAIHFANLMVNLLVPLDTSKNKLLRTSAPGDWESGSNSIVTNSI

SEQ ID NO: 78317 - protein, 331 aa, Homo sapiens
  Payload ID: 15601
  Gene Symbol: SBF2
  Gene Name: SET binding factor 2
  ENSP ID: ENSP00000432643
  MOD_RES (1)..(1): Any amino acid
XYQRLGLGTISGSSSRSRPEYFRITASNRMYSLCRSYPGLLVVPQAVQDSSLPRVARCYRHNRLPVVCWKNSRSGTLLLRSGGFHGKGVVGLFKSQNSPQAAPTSSLESSSSIEQEKYLQALLNAVSVHQKLRGNSTLTVRPAFALSPGTERRTSRMSTVLKQVVPGHLDVNPSNSFAQGGVWASLRSSTRLISSPTSFIDVGARLAGKDHSASFSNSSYLQNQLLKRQAALYIFGEKSQLRNFKVEFALNCEFVPVEFHEIRQVKASFKKLMRACIPSTIPTDSEVTFLKALGDSEWFPQLHRIMQLAVVVSEVLENGSSVLVCLEEGWD

SEQ ID NO: 78318 - protein, 132 aa, Homo sapiens
  Payload ID: 15601
  Gene Symbol: SBF2
  Gene Name: SET binding factor 2
  ENSP ID: ENSP00000434620
GEAGPRSQRRTVWPCYDDVSCTQPDALTSLFSEIEKLEHKLNQAPEKWQQLWERVTVDLKEEPRTDRSQRHLSRSPGIVSTNLPSYQKRSLLHLPDSSMGEEQNSSISPSNGVERRAATLYSQYTSKNDENR

SEQ ID NO: 78319 - protein, 1802 aa, Homo sapiens
  Payload ID: 15601
  Gene Symbol: SBF2
  Gene Name: SET binding factor 2
  ENSP ID: ENSP00000482806
FCQPGGWQLSRERKQPTFFVVVLTDIDSDRHYCSCLTFYEAEINLQGTKKEEIEGEAKVSGLIQPAEVFAPKSLVLVSRLYYPEIFRACLGLIYTVYVDSLNVSLESLIANLCACLVPAAGGSQKLFSLGAGDRQLIQTPLHDSLPITGTSVALLFQQLGIQNVLSLFCAVLTENKVLFHSASFQRLSDACRALESLMFPLKYSYPYIPILPAQLLEVLSSPTPFIIGVHSVFKTDVHELLDVIIADLDGGTIKIPECIHLSSLPEPLLHQTQSALSLILHPDLEVADHAFPPPRTALSHSKMLDKEVRAVFLRLFAQLFQGYRSCLQLIRIHAEPVIHFHKTAFLGQRGLVENDFLTKVLSGMAFAGFVSERGPPYRSCDLFDELVAFEVERIKVEENNPVKMIKHVRELAEQLFKNENPNPHMAFQKVPRPTEGSHLRVHILPFPEINEARVQELIQENVAKNQNAPPATRIEKKCVVPAGPPVVSIMDKVTTVFNSAQRLEVVRNCISFIFENKILETEKTLPAALRALKGKAARQCLTDELGLHVQQNRAILDHQQFDYIIRMMNCTLQDCSSLEEYNIAAALLPLTSAFYRKLAPGVSQFAYTCVQDHPIWTNQQFWETTFYNAVQEQVRSLYLSAKEDNHAPHLKQKDKLPDDHYQEKTAMDLAAEQLRLWPTLSKSTQQELVQHEESTVFSQAIHFANLMVNLLVPLDTSKNKLLRTSAPGDWESGSNSIVTNSIAGSVAESYDTESGFEDSENTDIANSVVRFITRFIDKVCTESGVTQDHIKSLHCMIPGIVAMHIETLEAVHRESRRLPPIQKPKILRPALLPGEEIVCEGLRVLLDPDGREEATGGLLGGPQLLPAEGALFLTTYRILFRGTPHDQLVGEQTVVRSFPIASITKEKKITMQNQLQQNMQEGLQITSASFQLIKVAFDEEVSPEVVEIFKKQLMKFRYPQSIFSTFAFAAGQTTPQIILPKQKEKNTSFRTFSKTIVKGAKRAGKMTIGRQYLLKKKTGTIVEERVNRPGWNEDDDVSVSDESELPTSTTLKASEKSTMEQLVEKACFRDYQRLGLGTISGSSSRSRPEYFRITASNRMYSLCRSYPGLLVVPQAVQDSSLPRVARCYRHNRLPVVCWKNSRSGTLLLRSGGFHGKGVVGLFKSQNSPQAAPTSSLESSSSIEQEKYLQALLNAVSVHQKLRGNSTLTVRPAFALSPGVWASLRSSTRLISSPTSFIDVGARLAGKDHSASFSNSSYLQNQLLKRQAALYIFGEKSQLRNFKVEFALNCEFVPVEFHEIRQVKASFKKLMRACIPSTIPTDSEVTFLKALGDSEWFPQLHRIMQLAVVVSEVLENGSSVLVCLEEGWDITAQVTSLVQLLSDPFYRTLEGFQMLVEKEWLSFGHKFSQRSSLTLNCQGSGFAPVFLQFLDCVHQVHNQYPTEFEFNLYYLKFLAFHYVSNRFKTFLLDSDYERLEHGTLFDDKGEKHAKKGVCIWECIDRMHKRSPIFFNYLYSPLEIEALKPNVNVSSLKKWDYYIEETLSTGPSYDWMMLTPKHFPSEDSDLAGEAGPRSQRRTVWPCYDDVSCTQPDALTSLFSEIEKLEHKLNQAPEKWQQLWERVTVDLKEEPRTDRSQRHLSRSPGIVSTNLPSYQKRSLLHLPDSSMGEEQNSSISPSNGVERRAATLYSQYTSKNDENRSFEGTLYKRGALLKGWKPRWFVLDVTKHQLRYYDSGEDTSCKGHIDLAEVEMVIPAGPSMGAPKHTSDKAFFDLKTSKRVYNFCAQDGQSAQQWMDKIQSCISDA

SEQ ID NO: 78320 - protein, 1596 aa, Homo sapiens
  Payload ID: 15602
  Gene Symbol: SETBP1
  Gene Name: SET binding protein 1
  Uniprot ID: Q9Y6X0
  ENSP ID: ENSP00000282030
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQAYERPQKHSTLHYDTGLPQDFTGDTLKPKHQQKSSSQNHMDWSTNSDSGPVTQNCFISPESGRETASTSKIPALEPVASFAKAQGKKGSAGNTWSQLSNNNKDLLLGGVAPSPSSHSSPAPPSSSAECNGLQPLVDQDGGGTKEPPEPPTVGSKKKSSKKDVISQTIPNPDLDWVKNAQKAFDNTEGKREGYSADSAQEASPARQNVSSASNPENDSSHVRITIPIKAPSLDPTNHKRKKRQSIKAVVEKIMPEKALASGITMSSEVVNRILSNSEGNKKDPRVPKLSKMIENESPSVGLETGGNAEKVIPGGVSKPRKPPMVMTPPTCTDHSPSRKLPEIQHPKFAAKRRWTCSKPKPSTMLREAVMATSDKLMLEPPSAYPITPSSPLYTNTDSLTVITPVKKKRGRPKKQPLLTVETIHEGTSTSPVSPISREFPGTKKRKRRRNLAKLAQLVPGEDKPMSEMKFHKKVGKLGVLDKKTIKTINKMKTLKRKNILNQILSCSSSVALKAKAPPETSPGAAAIESKLGKQINVSKRGTIYIGKKRGRKPRAELPPPSEEPKTAIKHPRPVSSQPDVPAVPSNFQSLVASSPAAMHPLSTQLGGSNGNLSPASTETNFSELKTMPNLQPISALPTKTQKGIHSGTWKLSPPRLMANSPSHLCEIGSLKEITLSPVSESHSEETIPSDSGIGTDNNSTSDQAEKSSESRRRYSFDFCSLDNPEAIPSDTSTKNRHGHRQKHLIVDNFLAHESLKKPKHKRKRKSLQNRDDLQFLADLEELITKFQVFRISHRSYTFYHENPYPSIFRINFDHYYPVPYIQYDPLLYLRRTSDLKSKKKRGRPAKTNDTMTKVPFLQGFSYPIPSGSYYAPYGMPYTSMPMMNLGYYGQYPAPLYLSHTLGAASPFMRPTVPPPQFHTNSHVKMSGAAKHKAKHGVHLQGPVSMGLGDMQPSLNPPKVGSASLSSGRLHKRKHKHKHKHKEDRILGTHDNLSGLFAGKATGFSSHILSERLSSADKELPLVSEKNKHKEKQKHQHSEAGHKASKNNFEVDTLSTLSLSDAQHWTQAKEKGDLSSEPVDSCTKRYSGSGGDGGSTRSENLDVFSEMNPSNDKWDSDVSGSKRRSYEGFGTYREKDIQAFKMNRKERSSYDSSMSPGMPSPHLKVDQTAVHSKNEGSVPTMMTRKKPAAVDSVTIPPAPVLSLLAASAATSDAVGSSLKKRFKRREIEAIQCEVRKMCNYTKILSTKKNLDHVNKILKAKRLQRQSKTGNNFVKKRRGRPRKQPTQFDEDSRDQMPVLEKCIDLPSKRGQKPSLSPLVLEPAASQDTIMATIEAVIHMAREAPPLPPPPPPPLPPPPPPPLPPPPPLPKTPRGGKRKHKPQAPAQPPQQSPPQQPLPQEEEVKAKRQRKSRGSESEVLP

SEQ ID NO: 78321 - protein, 242 aa, Homo sapiens
  Payload ID: 15602
  Gene Symbol: SETBP1
  Gene Name: SET binding protein 1
  Uniprot ID: Q9Y6X0
  ENSP ID: ENSP00000390687
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQIKDSSKEEVWKRRGGQGIPFKKQFLSQERAMCFSCPRNPFPAKPGSLTLPFHSEPAVWAQEV

SEQ ID NO: 78322 - protein, 137 aa, Homo sapiens
  Payload ID: 15602
  Gene Symbol: SETBP1
  Gene Name: SET binding protein 1
  ENSP ID: ENSP00000468506
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSG

SEQ ID NO: 78323 - protein, 212 aa, Homo sapiens
  Payload ID: 15603
  Gene Symbol: SETMAR
  Gene Name: SET domain and mariner transposase fusion gene
  ENSP ID: ENSP00000369673
MPRPGPFSVDPRHHLSKGVVLFSPFPEAQNRRPCENLAFCPVLSSELKEASRGESFTSLVSGVSHSSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLK

SEQ ID NO: 78324 - protein, 684 aa, Homo sapiens
  Payload ID: 15603
  Gene Symbol: SETMAR
  Gene Name: SET domain and mariner transposase fusion gene
  Uniprot ID: Q53H47
  ENSP ID: ENSP00000373354
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 78325 - protein, 171 aa, Homo sapiens
  Payload ID: 15603
  Gene Symbol: SETMAR
  Gene Name: SET domain and mariner transposase fusion gene
  ENSP ID: ENSP00000393044
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRKVEHQLWK

SEQ ID NO: 78326 - protein, 67 aa, Homo sapiens
  Payload ID: 15603
  Gene Symbol: SETMAR
  Gene Name: SET domain and mariner transposase fusion gene
  ENSP ID: ENSP00000397463
MFAEAAKTTRPCGMAEFKEKPEAPTEQLDVACGQENLPVGAWPPGAAPAPFQFSVLPRRKVEHQLWK

SEQ ID NO: 78327 - protein, 365 aa, Homo sapiens
  Payload ID: 15603
  Gene Symbol: SETMAR
  Gene Name: SET domain and mariner transposase fusion gene
  Uniprot ID: Q53H47
  ENSP ID: ENSP00000403000
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLEVSLFSDKQLAPPYSGRQWLASFTSA

SEQ ID NO: 78328 - protein, 545 aa, Homo sapiens
  Payload ID: 15603
  Gene Symbol: SETMAR
  Gene Name: SET domain and mariner transposase fusion gene
  Uniprot ID: Q53H47
  ENSP ID: ENSP00000403145
MFAEAAKTTRPCGMAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGSSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 78329 - protein, 366 aa, Homo sapiens
  Payload ID: 15604
  Gene Symbol: SETD7
  Gene Name: SET domain containing (lysine methyltransferase) 7
  Uniprot ID: Q8WTS6
  ENSP ID: ENSP00000274031
MDSDDEMVEEAVEGHLDDDGLPHGFCTVTYSSTDRFEGNFVHGEKNGRGKFFFFDGSTLEGYYVDDALQGQGVYTYEDGGVLQGTYVDGELNGPAQEYDTDGRLIFKGQYKDNIRHGVCWIYYPDGGSLVGEVNEDGEMTGEKIAYVYPDERTALYGKFIDGEMIEGKLATLMSTEEGRPHFELMPGNSVYHFDKSTSSCISTNALLPDPYESERVYVAESLISSAGEGLFSKVAVGPNTVMSFYNGVRITHQEVDSRDWALNGNTLSLDEETVIDVPEPYNHVSKYCASLGHKANHSFTPNCIYDMFVHPRFGPIKCIRTLRAVEADEELTVAYGYDHSPPGKSGPEAPEWYQVELKAFQATQQK

SEQ ID NO: 78330 - protein, 69 aa, Homo sapiens
  Payload ID: 15604
  Gene Symbol: SETD7
  Gene Name: SET domain containing (lysine methyltransferase) 7
  ENSP ID: ENSP00000384336
MTDYRTGSAQSPTPPQTDLRGTLFTEKRTDGGSSSSLMAAPWRGIMWMMPCRAREFTLTKMGEFSRARM

SEQ ID NO: 78331 - protein, 135 aa, Homo sapiens
  Payload ID: 15604
  Gene Symbol: SETD7
  Gene Name: SET domain containing (lysine methyltransferase) 7
  ENSP ID: ENSP00000385913
MDSDDEMVEEAVEGHLDDDGLPHGFCTVTYSSTDRFEGNFVHGEKNGRGKFFFFDGSTLEGYYVDDALQGQGVYTYEDGGVLQGTYVDGELNGPAQEYDTDGRLIFKGQYKDNIRHGVCWIYYPVSRVTVHSAGK

SEQ ID NO: 78332 - protein, 362 aa, Homo sapiens
  Payload ID: 15604
  Gene Symbol: SETD7
  Gene Name: SET domain containing (lysine methyltransferase) 7
  ENSP ID: ENSP00000427300
MDSDDEMVEEAVEGHLDDDGLPHGFCTVTYSSTDRFEGNFVHGEKNGRGKFFFFDGSTLEGYYVDDALQGQGVYTYEDGGVLQGTYVDGELNGPAQEYDTDGRLIFKGQYKDNIRHGVCWIYYPDGGSLVGEVNEDGEMTGEKIAYVYPDERTALYGKFIDGEMIEGKLATLMSTEEGRPHFELMPGNSVYHFDKSTSSCISTNALLPDPYESERVYVAESLISSAGEGLFSKVAVGPNTVMSFYNGVRITHQEVDSRDWALNGNTLSLDEETVIDVPEPYNHVSKYCASLGHKANHSFTPNCIYDIGQKNHLGTCKRSRFGAPLPKIPHLDQAPWVEHRKAGIPLYSAAQGLMLIMMFVSN

SEQ ID NO: 78333 - protein, 46 aa, Homo sapiens
  Payload ID: 15604
  Gene Symbol: SETD7
  Gene Name: SET domain containing (lysine methyltransferase) 7
  ENSP ID: ENSP00000476302
MMQPQEAELCRPHDATASGKCNCVHGESSAARTITSPGDRFIMKGL

SEQ ID NO: 78334 - protein, 94 aa, Homo sapiens
  Payload ID: 15604
  Gene Symbol: SETD7
  Gene Name: SET domain containing (lysine methyltransferase) 7
  ENSP ID: ENSP00000476712
MMQPQGHLDDDGLPHGFCTVTYSSTDRFEGNFVHGEKNGRGKFFFFDGSTLEGYYVDDALQGQGVYTYEDGGVLQGTYVDGELNGPAQEYDTDG

SEQ ID NO: 78335 - protein, 322 aa, Homo sapiens
  Payload ID: 15605
  Gene Symbol: SETD8
  Gene Name: SET domain containing (lysine methyltransferase) 8
  ENSP ID: ENSP00000332995
MVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTKLHDIDGVPHLILIASRDIAAGEELLYDYGDRSKASIEAHPWLKH

SEQ ID NO: 78336 - protein, 352 aa, Homo sapiens
  Payload ID: 15605
  Gene Symbol: SETD8
  Gene Name: SET domain containing (lysine methyltransferase) 8
  Uniprot ID: Q9NQR1
  ENSP ID: ENSP00000384629
MARGRKMSKPRAVEAAAAAAAVAATAPGPEMVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTKLHDIDGVPHLILIASRDIAAGEELLYDYGDRSKASIEAHPWLKH

SEQ ID NO: 78337 - protein, 91 aa, Homo sapiens
  Payload ID: 15605
  Gene Symbol: SETD8
  Gene Name: SET domain containing (lysine methyltransferase) 8
  ENSP ID: ENSP00000406830
MARGERIYRAVKDLFLHEPEQMLWNAFPPSGRELSYTSRSQMPGETISRNLQETRREKKCWERSTERHEVRGTEDQRRQERSPGTFSKPKI

SEQ ID NO: 78338 - protein, 299 aa, Homo sapiens
  Payload ID: 15605
  Gene Symbol: SETD8
  Gene Name: SET domain containing (lysine methyltransferase) 8
  ENSP ID: ENSP00000413811
MRWLWLLLFPDSPVTLREVLPSQPWRLRGCSDLRGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTK

SEQ ID NO: 78339 - protein, 1707 aa, Homo sapiens
  Payload ID: 15606
  Gene Symbol: SETD1A
  Gene Name: SET domain containing 1A
  Uniprot ID: O15047
  ENSP ID: ENSP00000262519
MDQEGGGDGQKAPSFQWRNYKLIVDPALDPALRRPSQKVYRYDGVHFSVNDSKYIPVEDLQDPRCHVRSKNRDFSLPVPKFKLDEFYIGQIPLKEVTFARLNDNVRETFLKDMCRKYGEVEEVEILLHPRTRKHLGLARVLFTSTRGAKETVKNLHLTSVMGNIIHAQLDIKGQQRMKYYELIVNGSYTPQTVPTGGKALSEKFQGSGAATETAESRRRSSSDTAAYPAGTTAVGTPGNGTPCSQDTSFSSSRQDTPSSFGQFTPQSSQGTPYTSRGSTPYSQDSAYSSSTTSTSFKPRRSENSYQDAFSRRHFSASSASTTASTAIAATTAATASSSASSSSLSSSSSSSSSSSSSQFRSSDANYPAYYESWNRYQRHTSYPPRRATREEPPGAPFAENTAERFPPSYTSYLPPEPSRPTDQDYRPPASEAPPPEPPEPGGGGGGGGPSPEREEVRTSPRPASPARSGSPAPETTNESVPFAQHSSLDSRIEMLLKEQRSKFSFLASDTEEEEENSSMVLGARDTGSEVPSGSGHGPCTPPPAPANFEDVAPTGSGEPGATRESPKANGQNQASPCSSGDDMEISDDDRGGSPPPAPTPPQQPPPPPPPPPPPPPYLASLPLGYPPHQPAYLLPPRPDGPPPPEYPPPPPPPPHIYDFVNSLELMDRLGAQWGGMPMSFQMQTQMLTRLHQLRQGKGLIAASAGPPGGAFGEAFLPFPPPQEAAYGLPYALYAQGQEGRGAYSREAYHLPMPMAAEPLPSSSVSGEEARLPPREEAELAEGKTLPTAGTVGRVLAMLVQEMKSIMQRDLNRKMVENVAFGAFDQWWESKEEKAKPFQNAAKQQAKEEDKEKTKLKEPGLLSLVDWAKSGGTTGIEAFAFGSGLRGALRLPSFKVKRKEPSEISEASEEKRPRPSTPAEEDEDDPEQEKEAGEPGRPGTKPPKRDEERGKTQGKHRKSFALDSEGEEASQESSSEKDEEDDEEDEEDEDREEAVDTTKKETEVSDGEDEESDSSSKCSLYADSDGENDSTSDSESSSSSSSSSSSSSSSSSSSSSSSSESSSEDEEEEERPAALPSASPPPREVPVPTPAPVEVPVPERVAGSPVTPLPEQEASPARPAGPTEESPPSAPLRPPEPPAGPPAPAPRPDERPSSPIPLLPPPKKRRKTVSFSAIEVVPAPEPPPATPPQAKFPGPASRKAPRGVERTIRNLPLDHASLVKSWPEEVSRGGRSRAGGRGRLTEEEEAEPGTEVDLAVLADLALTPARRGLPALPAVEDSEATETSDEAERPRPLLSHILLEHNYALAVKPTPPAPALRPPEPVPAPAALFSSPADEVLEAPEVVVAEAEEPKPQQLQQQREEGEEEGEEEGEEEEEESSDSSSSSDGEGALRRRSLRSHARRRRPPPPPPPPPPRAYEPRSEFEQMTILYDIWNSGLDSEDMSYLRLTYERLLQQTSGADWLNDTHWVHHTITNLTTPKRKRRPQDGPREHQTGSARSEGYYPISKKEKDKYLDVCPVSARQLEGVDTQGTNRVLSERRSEQRRLLSAIGTSAIMDSDLLKLNQLKFRKKKLRFGRSRIHEWGLFAMEPIAADEMVIEYVGQNIRQMVADMREKRYVQEGIGSSYLFRVDHDTIIDATKCGNLARFINHCCTPNCYAKVITIESQKKIVIYSKQPIGVDEEITYDYKFPLEDNKIPCLCGTESCRGSLN

SEQ ID NO: 78340 - protein, 247 aa, Homo sapiens
  Payload ID: 15606
  Gene Symbol: SETD1A
  Gene Name: SET domain containing 1A
  ENSP ID: ENSP00000391408
MDQEGGGDGQKAPSFQWRNYKLIVDPALDPALRRPSQKVYRYDGVHFSVNDSKYIPVEDLQDPRCHVRSKNRDFSLPVPKFKLDEFYIGQIPLKEVTFARLNDNVRETFLKDMCRKYGEVEEVEILLHPRTRKHLGLARVLFTSTRGAKETVKNLHLTSVMGNIIHAQLDIKGQQRMKYYELIVNGSYTPQTVPTGGKALSEKFQGSGAATETAESRRRSSSDTAAYPAGTTAVGTPGNGTPCSQDT

SEQ ID NO: 78341 - protein, 1923 aa, Homo sapiens [sequence omitted]

SEQ ID NO: 78342 - protein, 1923 aa, Homo sapiens
  Payload ID: 15607
  Gene Symbol: SETD1B
  Gene Name: SET domain containing 1B
  Uniprot ID: Q9UPS6
  ENSP ID: ENSP00000442924
MENSHPPHHHHQQPPPQPGPSGERRNHHWRSYKLMIDPALKKGHHKLYRYDGQHFSLAMSSNRPVEIVEDPRVVGIWTKNKELELSVPKFKIDEFYVGPVPPKQVTFAKLNDNIRENFLRDMCKKYGEVEEVEILYNPKTKKHLGIAKVVFATVRGAKDAVQHLHSTSVMGNIIHVELDTKGETRMRFYELLVTGRYTPQTLPVGELDAVSPIVNETLQLSDALKRLKDGGLSAGCGSGSSSVTPNSGGTPFSQDTAYSSCRLDTPNSYGQGTPLTPRLGTPFSQDSSYSSRQPTPSYLFSQDPAVTFKARRHESKFTDAYNRRHEHHYVHNSPAVTAVAGATAAFRGSSDLPFGAVGGTGGSSGPPFKAQPQDSATFAHTPPPAQATPAPGFKSAFSPYQTPVAHFPPPPEEPTATAAFGARDSGEFRRAPAPPPLPPAEPLAKEKPGTPPGPPPPDTNSMELGGRPTFGWSPEPCDSPGTPTLESSPAGPEKPHDSLDSRIEMLLKEQRTKLLFLREPDSDTELQMEGSPISSSSSQLSPLAPFGTNSQPGFRGPTPPSSRPSSTGLEDISPTPLPDSDEDEELDLGLGPRPPPEPGPPDPAGLLSQTAEVALDLVGDRTPTSEKMDEGQQSSGEDMEISDDEMPSAPITSADCPKPMVVTPGAAAVAAPSVLAPTLPLPPPPGFPPLPPPPPPPPPQPGFPMPPPLPPPPPPPPPAHPAVTVPPPPLPAPPGVPPPPILPPLPPFPPGLFPVMQVDMSHVLGGQWGGMPMSFQMQTQVLSRLMTGQGACPYPPFMAAAAAAASAGLQFVNLPPYRGPFSLSNSGPGRGQHWPPLPKFDPSVPPPGYMPRQEDPHKATVDGVLLVVLKELKAIMKRDLNRKMVEVVAFRAFDEWWDKKERMAKASLTPVKSGEHKDEDRPKPKDRIASCLLESWGKGEGLGYEGLGLGIGLRGAIRLPSFKVKRKEPPDTTSSGDQKRLRPSTSVDEEDEESERERDRDMADTPCELAKRDPKGVGVRRRPARPLELDSGGEEDEKESLSEEQESTEEEEEAEEEEEEEDDDDDDSDDRDESENDDEDTALSEASEKDEGDSDEEETVSIVTSKAEATSSSESSESSEFESSSESSPSSSEDEEEVVAREEEEEEEEEEMVAEESMASAGPEDFEQDGEEAALAPGAPAVDSLGMEEEVDIETEAVAPEERPSMLDEPPLPVGVEEPADSREPPEEPGLSQEGAMLLSPEPPAKEVEARPPLSPERAPEHDLEVEPEPPMMLPLPLQPPLPPPRPPRPPSPPPEPETTDASHPSVPPEPLAEDHPPHTPGLCGSLAKSQSTETVPATPGGEPPLSGGSSGLSLSSPQVPGSPFSYPAPSPSLSSGGLPRTPGRDFSFTPTFSEPSGPLLLPVCPLPTGRRDERSGPLASPVLLETGLPLPLPLPLPLPLALPAVLRAQARAPTPLPPLLPAPLASCPPPMKRKPGRPRRSPPSMLSLDGPLVRPPAGAALGRELLLLPGQPQTPVFPSTHDPRTVTLDFRNAGIPAPPPPLPPQPPPPPPPPPVEPTKLPFKELDNQWPSEAIPPGPRGRDEVTEEYMELAKSRGPWRRPPKKRHEDLVPPAGSPELSPPQPLFRPRSEFEEMTILYDIWNGGIDEEDIRFLCVTYERLLQQDNGMDWLNDTLWVYHPSTSLSSAKKKKRDDGIREHVTGCARSEGFYTIDKKDKLRYLNSSRASTDEPPADTQGMSIPAQPHASTRAGSERRSEQRRLLSSFTGSCDSDLLKFNQLKFRKKKLKFCKSHIHDWGLFAMEPIAADEMVIEYVGQNIRQVIADMREKRYEDEGIGSSYMFRVDHDTIIDATKCGNFARFINHSCNPNCYAKVITVESQKKIVIYSKQHINVNEEITYDYKFPIEDVKIPCLCGSENCRGTLN

SEQ ID NO: 78343 - protein, 1966 aa, Homo sapiens
  Payload ID: 15607
  Gene Symbol: SETD1B
  Gene Name: SET domain containing 1B
  Uniprot ID: Q9UPS6
  ENSP ID: ENSP00000474253
MENSHPPHHHHQQPPPQPGPSGERRNHHWRSYKLMIDPALKKGHHKLYRYDGQHFSLAMSSNRPVEIVEDPRVVGIWTKNKELELSVPKFKIDEFYVGPVPPKQVTFAKLNDNIRENFLRDMCKKYGEVEEVEILYNPKTKKHLGIAKVVFATVRGAKDAVQHLHSTSVMGNIIHVELDTKGETRMRFYELLVTGRYTPQTLPVGELDAVSPIVNETLQLSDALKRLKDGGLSAGCGSGSSSVTPNSGGTPFSQDTAYSSCRLDTPNSYGQGTPLTPRLGTPFSQDSSYSSRQPTPSYLFSQDPAVTFKARRHESKFTDAYNRRHEHHYVHNSPAVTAVAGATAAFRGSSDLPFGAVGGTGGSSGPPFKAQPQDSATFAHTPPPAQATPAPGFKSAFSPYQTPVAHFPPPPEEPTATAAFGARDSGEFRRAPAPPPLPPAEPLAKEKPGTPPGPPPPDTNSMELGGRPTFGWSPEPCDSPGTPTLESSPAGPEKPHDSLDSRIEMLLKEQRTKLLFLREPDSDTELQMEGSPISSSSSQLSPLAPFGTNSQPGFRGPTPPSSRPSSTGLEDISPTPLPDSDEDEELDLGLGPRPPPEPGPPDPAGLLSQTAEVALDLVGDRTPTSEKMDEGQQSSGEDMEISDDEMPSAPITSADCPKPMVVTPGAAAVAAPSVLAPTLPLPPPPGFPPLPPPPPPPPPQPGFPMPPPLPPPPPPPPPAHPAVTVPPPPLPAPPGVPPPPILPPLPPFPPGLFPVMQVDMSHVLGGQWGGMPMSFQMQTQVLSRLMTGQGACPYPPFMAAAAAAASAGLQFVNLPPYRGPFSLSNSGPGRGQHWPPLPKFDPSVPPPGYMPRQEDPHKATVDGVLLVVLKELKAIMKRDLNRKMVEVVAFRAFDEWWDKKERMAKASLTPVKSGEHKDEDRPKPKDRIASCLLESWGKGEGLGYEGLGLGIGLRGAIRLPSFKVKRKEPPDTTSSGDQKRLRPSTSVDEEDEESERERDRDMADTPCELAKRDPKGVGVRRRPARPLELDSGGEEDEKESLSASSSSSASSSSGSSTTSPSSSASDKEEEQESTEEEEEAEEEEEEEVPRSQLSSSSTSSTSDKDDDDDDSDDRDESENDDEDTALSEASEKDEGDSDEEETVSIVTSKAEATSSSESSESSEFESSSESSPSSSEDEEEVVAREEEEEEEEEEMVAEESMASAGPEDFEQDGEEAALAPGAPAVDSLGMEEEVDIETEAVAPEERPSMLDEPPLPVGVEEPADSREPPEEPGLSQEGAMLLSPEPPAKEVEARPPLSPERAPEHDLEVEPEPPMMLPLPLQPPLPPPRPPRPPSPPPEPETTDASHPSVPPEPLAEDHPPHTPGLCGSLAKSQSTETVPATPGGEPPLSGGSSGLSLSSPQVPGSPFSYPAPSPSLSSGGLPRTPGRDFSFTPTFSEPSGPLLLPVCPLPTGRRDERSGPLASPVLLETGLPLPLPLPLPLPLALPAVLRAQARAPTPLPPLLPAPLASCPPPMKRKPGRPRRSPPSMLSLDGPLVRPPAGAALGRELLLLPGQPQTPVFPSTHDPRTVTLDFRNAGIPAPPPPLPPQPPPPPPPPPVEPTKLPFKELDNQWPSEAIPPGPRGRDEVTEEYMELAKSRGPWRRPPKKRHEDLVPPAGSPELSPPQPLFRPRSEFEEMTILYDIWNGGIDEEDIRFLCVTYERLLQQDNGMDWLNDTLWVYHPSTSLSSAKKKKRDDGIREHVTGCARSEGFYTIDKKDKLRYLNSSRASTDEPPADTQGMSIPAQPHASTRAGSERRSEQRRLLSSFTGSCDSDLLKFNQLKFRKKKLKFCKSHIHDWGLFAMEPIAADEMVIEYVGQNIRQVIADMREKRYEDEGIGSSYMFRVDHDTIIDATKCGNFARFINHSCNPNCYAKVITVESQKKIVIYSKQHINVNEEITYDYKFPIEDVKIPCLCGSENCRGTLN

SEQ ID NO: 78344 - protein, 1966 aa, Homo sapiens; identical to SEQ ID NO: 78343
  Payload ID: 15607
  Gene Symbol: SETD1B
  Gene Name: SET domain containing 1B
  Uniprot ID: Q9UPS6
  ENSP ID: ENSP00000481531

SEQ ID NO: 78345 - protein, 1365 aa, Homo sapiens
  Payload ID: 15608
  Gene Symbol: SETD2
  Gene Name: SET domain containing 2
  ENSP ID: ENSP00000332415
  MOD_RES (1)..(1): Any amino acid
XSSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERMKYLWVLY

SEQ ID NO: 78346 - protein, 2564 aa, Homo sapiens
  Payload ID: 15608
  Gene Symbol: SETD2
  Gene Name: SET domain containing 2
  Uniprot ID: Q9BYW2
  ENSP ID: ENSP00000386759
MKQLQPQPPPKMGDFYDPEHPTPEEEENEAKIENVQKTGFIKGPMFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 78347 - protein, 1290 aa, Homo sapiens
  Payload ID: 15608
  Gene Symbol: SETD2
  Gene Name: SET domain containing 2
  ENSP ID: ENSP00000388349
  MOD_RES (1)..(1): Any amino acid
XSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPS

SEQ ID NO: 78348 - protein, 1675 aa, Homo sapiens
  Payload ID: 15608
  Gene Symbol: SETD2
  Gene Name: SET domain containing 2
  ENSP ID: ENSP00000411901
  MOD_RES (1)..(1): Any amino acid
XRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTRNQPE

SEQ ID NO: 78349 - protein, 1340 aa, Homo sapiens
  Payload ID: 15608
  Gene Symbol: SETD2
  Gene Name: SET domain containing 2
  ENSP ID: ENSP00000416401
MFKGVASSRFLPKGTKTKVNLEEQGRQKVSFSFSLTKKTLQNRFLTALGNEKQSDTPNPPAVPLQVDSTPKMKMEIGDTLSTAEESSPPKSRVELGKIHFKKHLLHVTSRPLLATTTAVASPPTHAAPLPAVIAESTTVDSPPSSPPPPPPPAQATTLSSPAPVTEPVALPHTPITVLMAAPVPLPVDVAVRSLKEPPIIIVPESLEADTKQDTISNSLEEHVTQILNEQADISSKKEDSHIGKDEEIPDSSKISLSCKKTGSKKKSSQSEGIFLGSESDEDSVRTSSSQRSHDLKFSASIEKERDFKKSSAPLKSEDLGKPSRSKTDRDDKYFSYSKLERDTRYVSSRCRSERERRRSRSHSRSERGSRTNLSYSRSERSHYYDSDRRYHRSSPYRERTRYSRPYTDNRARESSDSEEEYKKTYSRRTSSHSSSYRDLRTSSYSKSDRDCKTETSYLEMERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVN

SEQ ID NO: 78350 - protein, 594 aa, Homo sapiens
  Payload ID: 15609
  Gene Symbol: SETD3
  Gene Name: SET domain containing 3
  Uniprot ID: Q86TU7
  ENSP ID: ENSP00000327436
MGKKSRVKTQKSGTGATATVSPKEILNLTSELLQKCSSPAPGPGKEWEEYVQIRTLVEKIRKKQKGLSVTFDGKREDYFPDLMKWASENGASVEGFEMVNFKEEGFGLRATRDIKAEELFLWVPRKLLMTVESAKNSVLGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLITTGYNLEDDRCECVALQDFRAGEQIYIFYGTRSNAEFVIHSGFFFDNNSHDRVKIKLGVSKSDRLYAMKAEVLARAGIPTSSVFALHFTEPPISAQLLAFLRVFCMTEEELKEHLLGDSAIDRIFTLGNSEFPVSWDNEVKLWTFLEDRASLLLKTYKTTIEEDKSVLKNHDLSVRAKMAIKLRLGEKEILEKAVKSAAVNREYYRQQMEEKAPLPKYEESNLGLLESSVGDSRLPLVLRNLEEEAGVQDALNIREAISKAKATENGLVNGENSIPNGTRSENESLNQESKRAVEDAKGSSSDSTAGVKE

SEQ ID NO: 78351 - protein, 296 aa, Homo sapiens
  Payload ID: 15609
  Gene Symbol: SETD3
  Gene Name: SET domain containing 3
  Uniprot ID: Q86TU7
  ENSP ID: ENSP00000327910
MGKKSRVKTQKSGTGATATVSPKEILNLTSELLQKCSSPAPGPGKEWEEYVQIRTLVEKIRKKQKGLSVTFDGKREDYFPDLMKWASENGASVEGFEMVNFKEEGFGLRATRDIKAEELFLWVPRKLLMTVESAKNSVLGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLTPEDSFALAVASA

SEQ ID NO: 78352 - protein, 81 aa, Homo sapiens
  Payload ID: 15609
  Gene Symbol: SETD3
  Gene Name: SET domain containing 3
  ENSP ID: ENSP00000350174
MGKKSRVKTQKSGTGATATVSPKEILNLTSELLQKCSSPAPGPGKEWEEYVQIRTLVEKIRKKQKGRRIVFMGSTKIANDC

SEQ ID NO: 78353 - protein, 81 aa, Homo sapiens; identical to SEQ ID NO: 78352
  Payload ID: 15609
  Gene Symbol: SETD3
  Gene Name: SET domain containing 3
  ENSP ID: ENSP00000396870

SEQ ID NO: 78354 - protein, 81 aa, Homo sapiens; identical to SEQ ID NO: 78352
  Payload ID: 15609
  Gene Symbol: SETD3
  Gene Name: SET domain containing 3
  ENSP ID: ENSP00000398966

SEQ ID NO: 78355 - protein, 292 aa, Homo sapiens
  Payload ID: 15609
  Gene Symbol: SETD3
  Gene Name: SET domain containing 3
  ENSP ID: ENSP00000408602
MGKKSRVKTQKSGTGATATVSPKEILNLTSELLQKCSSPAPGPGKEWEEYVQIRTLVEKIRKKQKGLSVTFDGKREDYFPDLMKWASENGASVEGFEMVNFKEEGFGLRATRDIKAEELFLWVPRKLLMTVESAKNSVLGPLYSQDRILQAMGNIALAFHLLCERASPNSFWQPYIQTLPSEYDTPLYFEEDEVRYLQSTQAIHDVFSQYKNTARQYAYFYKVIQTHPHANKLPLKDSFTYEDYRWAVSSVMTRQNQIPTEDGSRVTLALIPLWDMCNHTNGLVTTSSPVLC

SEQ ID NO: 78356 - protein, 81 aa, Homo sapiens; identical to SEQ ID NO: 78352
  Payload ID: 15609
  Gene Symbol: SETD3
  Gene Name: SET domain containing 3
  ENSP ID: ENSP00000486445

SEQ ID NO: 78357 - protein, 440 aa, Homo sapiens
  Payload ID: 15610
  Gene Symbol: SETD4
  Gene Name: SET domain containing 4
  Uniprot ID: Q9NVD3
  ENSP ID: ENSP00000329189
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSREILVKYLPSTDKQMDKKISILKDHGYIENLTFGWDGPSWRLLTALKLLCLEAEKFTCWKKVLLGEVISDTNEKTSLDIAQKICYYFIEETNAVLQKVSHMKDEKEALINQLTLVESLWTEELKILRASAETLHSLQTAFT

SEQ ID NO: 78358 - protein, 283 aa, Homo sapiens
  Payload ID: 15610
  Gene Symbol: SETD4
  Gene Name: SET domain containing 4
  ENSP ID: ENSP00000382152
MNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSRGWNQLCS

SEQ ID NO: 78359 - protein, 283 aa, Homo sapiens; identical to SEQ ID NO: 78358
  Payload ID: 15610
  Gene Symbol: SETD4
  Gene Name: SET domain containing 4
  ENSP ID: ENSP00000382156

SEQ ID NO: 78360 - protein, 307 aa, Homo sapiens
  Payload ID: 15610
  Gene Symbol: SETD4
  Gene Name: SET domain containing 4
  Uniprot ID: Q9NVD3
  ENSP ID: ENSP00000382158
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSRGWNQLCS

SEQ ID NO: 78361 - protein, 307 aa, Homo sapiens; identical to SEQ ID NO: 78360
  Payload ID: 15610
  Gene Symbol: SETD4
  Gene Name: SET domain containing 4
  Uniprot ID: Q9NVD3
  ENSP ID: ENSP00000382159

SEQ ID NO: 78362 - protein, 416 aa, Homo sapiens
  Payload ID: 15610
  Gene Symbol: SETD4
  Gene Name: SET domain containing 4
  Uniprot ID: Q9NVD3
  ENSP ID: ENSP00000382161
MNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPYLDLLNHSPHVQVKAAFNEETHSYEIRTTSRWRKHEEVFICYGPHDNQRLFLEYGFVSVHNPHACVYVSREILVKYLPSTDKQMDKKISILKDHGYIENLTFGWDGPSWRLLTALKLLCLEAEKFTCWKKVLLGEVISDTNEKTSLDIAQKICYYFIEETNAVLQKVSHMKDEKEALINQLTLVESLWTEELKILRASAETLHSLQTAFT

SEQ ID NO: 78363 - protein, 440 aa, Homo sapiens; identical to SEQ ID NO: 78357
  Payload ID: 15610
  Gene Symbol: SETD4
  Gene Name: SET domain containing 4
  Uniprot ID: Q9NVD3
  ENSP ID: ENSP00000382163

SEQ ID NO: 78364 - protein, 67 aa, Homo sapiens
  Payload ID: 15610
  Gene Symbol: SETD4
  Gene Name: SET domain containing 4
  ENSP ID: ENSP00000392463
MQKGKGRTSRIRRRKLCGSSESRGVNESHKSEFIELRKWLKARKFQDSNLAPACFPGTGRGLMSQTS

SEQ ID NO: 78365 - protein, 70 aa, Homo sapiens
  Payload ID: 15610
  Gene Symbol: SETD4
  Gene Name: SET domain containing 4
  ENSP ID: ENSP00000394822
MNESHKSEFIELRKWLKARKFQDSNLAPACFPGTGRGLMSQTSLQEGQMIISLPESCLLTTDTVIRSYLG

SEQ ID NO: 78366 - protein, 225 aa, Homo sapiens
  Payload ID: 15610
  Gene Symbol: SETD4
  Gene Name: SET domain containing 4
  ENSP ID: ENSP00000396837
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDT

SEQ ID NO: 78367 - protein, 231 aa, Homo sapiens
  Payload ID: 15610
  Gene Symbol: SETD4
  Gene Name: SET domain containing 4
  ENSP ID: ENSP00000399998
MQKGKGRTSRIRRRKLCGSSESRGVNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVVNLLPKSLKAKAEEQRAHVQEFFASSRDFFSSLQPLFAEAVDSIFSYSALLWAWCTVNTRAVYLRPRQRECLSAEPDTCALAPY

SEQ ID NO: 78368 - protein, 124 aa, Homo sapiens
  Payload ID: 15610
  Gene Symbol: SETD4
  Gene Name: SET domain containing 4
  ENSP ID: ENSP00000413318
MNESHKSEFIELRKWLKARKFQDSNLAPACFPGTGRGLMSQTSLQEGQMIISLPESCLLTTDTVIRSYLGAYITKWKPPPSPLLALCTFLVSEKHAGHRSLWKPYLEILPKAYTCPVCLEPEVV

SEQ ID NO: 78369 - protein, 1344 aa, Homo sapiens
  Payload ID: 15611
  Gene Symbol: SETD5
  Gene Name: SET domain containing 5
  Uniprot ID: Q9C0A6
  ENSP ID: ENSP00000302028
MSRGKVIRLHRRKQDNISGGDSSATESWDEELSPSTVLYTATQHTPTSITLTVRRTKPKKRKKSPEKGRAAPKTKKIKAFREGSRKSLRMKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 78370 - protein, 911 aa, Homo sapiens
  Payload ID: 15611
  Gene Symbol: SETD5
  Gene Name: SET domain containing 5
  ENSP ID: ENSP00000382593
  MOD_RES (1)..(1): Any amino acid
XVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQICD

SEQ ID NO: 78371 - protein, 1442 aa, Homo sapiens
  Payload ID: 15611
  Gene Symbol: SETD5
  Gene Name: SET domain containing 5
  Uniprot ID: Q9C0A6
  ENSP ID: ENSP00000383939
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 78372 - protein, 1461 aa, Homo sapiens
  Payload ID: 15611
  Gene Symbol: SETD5
  Gene Name: SET domain containing 5
  ENSP ID: ENSP00000384114
MSIAIPLGVTTSDTSYSDMAAGSDPESVEASPAVNEKSVYSTHNYGTTQRHGCRGLPYADHNYGAPPPPTPPASPPVQTIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 78373 - protein, 1442 aa, Homo sapiens; identical to SEQ ID NO: 78371
  Payload ID: 15611
  Gene Symbol: SETD5
  Gene Name: SET domain containing 5
  Uniprot ID: Q9C0A6
  ENSP ID: ENSP00000385852

SEQ ID NO: 78374 - protein, 52 aa, Homo sapiens
  Payload ID: 15611
  Gene Symbol: SETD5
  Gene Name: SET domain containing 5
  ENSP ID: ENSP00000393221
MSIAIPLGVTTSDTSYSDMAAGSEKEVEAPYLSRRSGTTPGCESPAKETQGA

SEQ ID NO: 78375 - protein, 65 aa, Homo sapiens
  Payload ID: 15611
  Gene Symbol: SETD5
  Gene Name: SET domain containing 5
  ENSP ID: ENSP00000395959
MSIAIPLGVTTSDTSYSDMAAGSEVSCLGSEWKRAWSLGQCRRHFDHLTHCKCHVRFHGSIKRSN

SEQ ID NO: 78376 - protein, 52 aa, Homo sapiens; identical to SEQ ID NO: 78374
  Payload ID: 15611
  Gene Symbol: SETD5
  Gene Name: SET domain containing 5
  ENSP ID: ENSP00000397076

SEQ ID NO: 78377 - protein, 441 aa, Homo sapiens
  Payload ID: 15611
  Gene Symbol: SETD5
  Gene Name: SET domain containing 5
  ENSP ID: ENSP00000399993
  MOD_RES (1)..(1): Any amino acid
XNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFENISSPESSPAHRPESLSPELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDT

SEQ ID NO: 78378 - protein, 177 aa, Homo sapiens
  Payload ID: 15611
  Gene Symbol: SETD5
  Gene Name: SET domain containing 5
  ENSP ID: ENSP00000401554
  MOD_RES (1)..(1): Any amino acid
XEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHESLSTAEYCLYLKGSRQSRRKTRRRERRGYR

SEQ ID NO: 78379 - protein, 170 aa, Homo sapiens
  Payload ID: 15611
  Gene Symbol: SETD5
  Gene Name: SET domain containing 5
  ENSP ID: ENSP00000408837
MSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQK

SEQ ID NO: 78380 - protein, 162 aa, Homo sapiens
  Payload ID: 15611
  Gene Symbol: SETD5
  Gene Name: SET domain containing 5
  ENSP ID: ENSP00000413786
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITL

SEQ ID NO: 78381 - protein, 473 aa, Homo sapiens
  Payload ID: 15612
  Gene Symbol: SETD6
  Gene Name: SET domain containing 6
  Uniprot ID: Q8TBK2
  ENSP ID: ENSP00000219315
MATQAKRPRVAGPVDGGDLDPVACFLSWCRRVGLELSPKVSERAGGRRTRGGARAALTSPPAQVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSANCLRMVATQPIPKGHEIFNTYGQMANWQLIHMYGFVEPYPDNTDDTADIQMVTVREAALQGTKTEAERHLVYERWDFLCKLEMVGEEGAFVIGREEVLTEEELTTTLKVLCMPAEEFRELKDQDGGGDDKREEGSLTITNIPKLKASWRQLLQNSVLLTLQTYATDLKTDQGLLSNKEVYAKLSWREQQALQVRYGQKMILHQLLELTS

SEQ ID NO: 78382 - protein, 449 aa, Homo sapiens
  Payload ID: 15612
  Gene Symbol: SETD6
  Gene Name: SET domain containing 6
  Uniprot ID: Q8TBK2
  ENSP ID: ENSP00000310082
MATQAKRPRVAGPVDGGDLDPVACFLSWCRRVGLELSPKVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSANCLRMVATQPIPKGHEIFNTYGQMANWQLIHMYGFVEPYPDNTDDTADIQMVTVREAALQGTKTEAERHLVYERWDFLCKLEMVGEEGAFVIGREEVLTEEELTTTLKVLCMPAEEFRELKDQDGGGDDKREEGSLTITNIPKLKASWRQLLQNSVLLTLQTYATDLKTDQGLLSNKEVYAKLSWREQQALQVRYGQKMILHQLLELTS

SEQ ID NO: 78383 - protein, 404 aa, Homo sapiens
  Payload ID: 15612
  Gene Symbol: SETD6
  Gene Name: SET domain containing 6
  ENSP ID: ENSP00000377809
MATQAKRPRVAGPVDGGDLDPVACFLSWCRRVGLELSPKVAVSRQGTVAGYGMVARESVQAGELLFVVPRAALLSQHTCSIGGLLERERVALQSQSGWVPLLLALLHELQAPASRWRPYFALWPELGRLEHPMFCLRVRSLELYHQLVALVMAYSFQEPLEEEEDEKEPNSPVMVPAADILNHLANHNANLEYSANCLRMVATQPIPKGHEIFNTYGQMANWQLIHMYGFVEPYPDNTDDTADIQMVTVREAALQGTKTEAERHLVYERWDFLCKLEMVGEEGAFVIGREEVLTEEELTTTLKVLCMPAEEFRELKDQDGGGDDKREEGSLTITNIPKLKASWRQLLQNSVLLTLQTYATDLKTDQGLLSNKEVYAKLSWREQQALQVRYGQKMILHQLLELTS

SEQ ID NO: 78384 - protein, 183 aa, Homo sapiens
  Payload ID: 15612
  Gene Symbol: SETD6
  Gene Name: SET domain containing 6
  ENSP ID: ENSP00000396437
MATQAKRPRVAGPVDGGDLDPVACFLSWCRRVGLELSPKSELRCRASRAGCHCCWRCSTSCRPRPHAGGPTLRSGPSWAAWSTRCSGTKTEAERHLVYERWDFLCKLEMVGEEGAFVIGREEVLTEEELTTTLKVLCMPAEEFRELKDQDGGGDDKREEGSLTITNIPKLKASWRQLLQNSVL

SEQ ID NO: 78385 - protein, 262 aa, Homo sapiens
  Payload ID: 15612
  Gene Symbol: SETD6
  Gene Name: SET domain containing 6
  ENSP ID: ENSP00000398033
MATQAKRPRVAGPVDGGDLDPVACFLSWCRRVGLELSPKVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSAAWPQLLPFTSELSSDGSHSAHS

SEQ ID NO: 78386 - protein, 263 aa, Homo sapiens
  Payload ID: 15612
  Gene Symbol: SETD6
  Gene Name: SET domain containing 6
  ENSP ID: ENSP00000412858
VAGPVDGGDLDPVACFLSWCRRVGLELSPKVSERAGGRRTRGGARAALTSPPAQVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSAMTQLTFRW

SEQ ID NO: 78387 - protein, 299 aa, Homo sapiens
  Payload ID: 15613
  Gene Symbol: SETD9
  Gene Name: SET domain containing 9
  Uniprot ID: Q8NE22
  ENSP ID: ENSP00000285947
MPGRLLRGLWQRWRRYKYRFVPWIALNLSHNPRTLRYVPEESKDKVISDEDVLGTLLKVFQALFLNDFNKQSEILSMLPESVKSKYQDLLAVEHQGVKLLENRHQQQSTFKPEEILYKTLGFSVAQATSSLISAGKGVFVTKGLVPKGAVVSMYPGTVYQKYEPIFFQSIGNPFIFRCLDGVLIDGNDKGISKVVYRSCNGRDRLGPLKMSDSTWLTSEIHNPLAVGQYVNNCSNDRAANVCYQEFDVPAVFPIELKQYLPNIAYSYDKQSPLRCVVLVALRDINQGEELFSNYYTIVS

SEQ ID NO: 78388 - protein, 39 aa, Homo sapiens
  Payload ID: 15613
  Gene Symbol: SETD9
  Gene Name: SET domain containing 9
  ENSP ID: ENSP00000398449
MPGRLLRGLWQRWRRYKYRFVPWIALNLSHNPRYSISEV

SEQ ID NO: 78389 - protein, 49 aa, Homo sapiens
  Payload ID: 15613
  Gene Symbol: SETD9
  Gene Name: SET domain containing 9
  ENSP ID: ENSP00000406183
MVGFGLGTLRYVPEESKDKVISDEDVLGTLLKVFQALFLNDFNKQSEIL

SEQ ID NO: 78390 - protein, 271 aa, Homo sapiens
  Payload ID: 15613
  Gene Symbol: SETD9
  Gene Name: SET domain containing 9
  Uniprot ID: Q8NE22
  ENSP ID: ENSP00000486609
MPGRLLRGLWQRWRRYKYRFVPWIALNLSHNPRTLRYVPEESKDKVISDEDVLGTLLKVFQALFLNDFNKQSEILSMLPESVKSKYQDLLAVEHQGVKLLENRHQQQSTFKPEEILYKTLGFSVAQATSSLISAGKGVFVTKGLVPKGAVVSMYPGTVYQKYEPIFFQSIGNPFIFRCLDGVLIDGNDKGISKVVYRSCNGRDRLGPLKMSDSTWLTSEIHNPLAVGQYVNNCSNDRAANVCYQEFDVPAVFPIELKQYLPNIAYSYDKQR

SEQ ID NO: 78391 - protein, 1291 aa, Homo sapiens
  Payload ID: 15614
  Gene Symbol: SETDB1
  Gene Name: SET domain, bifurcated 1
  Uniprot ID: Q15047
  ENSP ID: ENSP00000271640
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 78392 - protein, 397 aa, Homo sapiens
  Payload ID: 15614
  Gene Symbol: SETDB1
  Gene Name: SET domain, bifurcated 1
  Uniprot ID: Q15047
  ENSP ID: ENSP00000357958
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLVLFFSTILEAEVGGGGT

SEQ ID NO: 78393 - protein, 249 aa, Homo sapiens
  Payload ID: 15614
  Gene Symbol: SETDB1
  Gene Name: SET domain, bifurcated 1
  ENSP ID: ENSP00000357959
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGFSFSLMMAMLPMSHSRNCIPFAGH

SEQ ID NO: 78394 - protein, 111 aa, Homo sapiens
  Payload ID: 15614
  Gene Symbol: SETDB1
  Gene Name: SET domain, bifurcated 1
  ENSP ID: ENSP00000357960
MSSLPGCIGLDAATATVESEEIAELQQAVVEELGISMEELRHFIDEELEKMDCVQQRKKQLAELETWVIQKESEVAHVDQLFDDASRTSTPSWDYNTGTVALRTNLPGLQK

SEQ ID NO: 78395 - protein, 1290 aa, Homo sapiens
  Payload ID: 15614
  Gene Symbol: SETDB1
  Gene Name: SET domain, bifurcated 1
  Uniprot ID: Q15047
  ENSP ID: ENSP00000357965
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKIRAGTELTWDYNYEVGSVEGKELLCCCGAIECRGRLL

SEQ ID NO: 78396 - protein, 150 aa, Homo sapiens
  Payload ID: 15614
  Gene Symbol: SETDB1
  Gene Name: SET domain, bifurcated 1
  ENSP ID: ENSP00000407831
MCEVFGLWILEDKSMSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSID

SEQ ID NO: 78397 - protein, 156 aa, Homo sapiens
  Payload ID: 15614
  Gene Symbol: SETDB1
  Gene Name: SET domain, bifurcated 1
  ENSP ID: ENSP00000409379
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAA

SEQ ID NO: 78398 - protein, 1259 aa, Homo sapiens
  Payload ID: 15614
  Gene Symbol: SETDB1
  Gene Name: SET domain, bifurcated 1
  ENSP ID: ENSP00000432348
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNVRPLSPPLDAGLSHGPQISFNILYKPFSCYKLLISK

SEQ ID NO: 78399 - protein, 163 aa, Homo sapiens
  Payload ID: 15614
  Gene Symbol: SETDB1
  Gene Name: SET domain, bifurcated 1
  ENSP ID: ENSP00000435922
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQD

SEQ ID NO: 78400 - protein, 636 aa, Homo sapiens
  Payload ID: 15614
  Gene Symbol: SETDB1
  Gene Name: SET domain, bifurcated 1
  ENSP ID: ENSP00000436148
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSESLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCL

SEQ ID NO: 78401 - protein, 548 aa, Homo sapiens
  Payload ID: 15615
  Gene Symbol: SETDB2
  Gene Name: SET domain, bifurcated 2
  ENSP ID: ENSP00000258672
MGEKNGDAKTFWMELEDDGKVDFIFEQVQNVLQSLKQKIKDGSATNKEYIQAMILVNEATIINSSTSIKDPMPVTQKEQENKSNAFPSTSCENSFPEDCTFLTTENKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQSRLCFFCECLPLLPVSLSLAQYL

SEQ ID NO: 78402 - protein, 707 aa, Homo sapiens
  Payload ID: 15615
  Gene Symbol: SETDB2
  Gene Name: SET domain, bifurcated 2
  Uniprot ID: Q96T68
  ENSP ID: ENSP00000326477
MGEKNGDAKTFWMELEDDGKVDFIFEQVQNVLQSLKQKIKDGSATNKEYIQAMILVNEATIINSSTSIKDPMPVTQKEQENKSNAFPSTSCENSFPEDCTFLTTENKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 78403 - protein, 719 aa, Homo sapiens
  Payload ID: 15615
  Gene Symbol: SETDB2
  Gene Name: SET domain, bifurcated 2
  Uniprot ID: Q96T68
  ENSP ID: ENSP00000346175
MGEKNGDAKTFWMELEDDGKVDFIFEQVQNVLQSLKQKIKDGSATNKEYIQAMILVNEATIINSSTSIKGASQKEVNAQSSDPMPVTQKEQENKSNAFPSTSCENSFPEDCTFLTTENKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 78404 - protein, 719 aa, Homo sapiens
  Payload ID: 15615
  Gene Symbol: SETDB2
  Gene Name: SET domain, bifurcated 2
  ENSP ID: ENSP00000482240
MGKKPSDAKTFWMELEDDGKVDFIFEQVQNVLQSLKQKIKDGSATNKEYIQAMILVNEATIINSSTSIKGASQKEVNAQSSDPMPVTQKEQENKSNAFPSTSCENSFPEDCTFLTTENKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTVETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 78405 - protein, 277 aa, Homo sapiens
  Payload ID: 15616
  Gene Symbol: SET
  Gene Name: SET nuclear proto-oncogene
  Uniprot ID: Q01105
  ENSP ID: ENSP00000318012
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 78406 - protein, 265 aa, Homo sapiens
  Payload ID: 15616
  Gene Symbol: SET
  Gene Name: SET nuclear proto-oncogene
  Uniprot ID: Q01105
  ENSP ID: ENSP00000361771
MPRSHQPPPPPHEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 78407 - protein, 266 aa, Homo sapiens
  Payload ID: 15616
  Gene Symbol: SET
  Gene Name: SET nuclear proto-oncogene
  ENSP ID: ENSP00000361773
MMPRSHQPPPPPHEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 78408 - protein, 290 aa, Homo sapiens
  Payload ID: 15616
  Gene Symbol: SET
  Gene Name: SET nuclear proto-oncogene
  Uniprot ID: Q01105
  ENSP ID: ENSP00000361777
MAPKRQSPLPPQKKKPRPPPALGPEETSASAGLPKKGEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 78409 - protein, 268 aa, Homo sapiens
  Payload ID: 15616
  Gene Symbol: SET
  Gene Name: SET nuclear proto-oncogene
  Uniprot ID: Q01105
  ENSP ID: ENSP00000387321
MGCRDLLPSLKPTLLEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 78410 - protein, 32 aa, Homo sapiens
  Payload ID: 15616
  Gene Symbol: SET
  Gene Name: SET nuclear proto-oncogene
  ENSP ID: ENSP00000410806
MAPKRQSPLPPQKKKPRPPPALGPEETSASAG

SEQ ID NO: 78411 - protein, 302 aa, Homo sapiens
  Payload ID: 15617
  Gene Symbol: SETSIP
  Gene Name: SET-like protein
  Uniprot ID: P0DME0
  ENSP ID: ENSP00000480946
MVWFLDFPNSMAPKRQSPLPLQKKKPRPPPALGLEETSASAGLPKKGEKEQQEAIEHIDEVQNEIDRLNEQDSEEILKVEQKYNKLRQPFFQKRSELIAKIPNFGVTTFVNHPQVSSLLGEEDEEALHYLTKVEVTEFEDIKSGYRIDFYFDENPYFENKVFSKEFHLNESGDPSSKSTKIKWKSGKDVTKRSSQTQNKASRKRQHEEPESFFTWFTDHSDAGADELEEVIKDDIWPNPLQYYLVPDMDDEEGGEDDDDDDDDGDEGEEELEDIDEGDEDEGEEDEDDDEGEEGEEDEGEDD

SEQ ID NO: 78412 - protein, 292 aa, Homo sapiens
  Payload ID: 15617
  Gene Symbol: SETSIP
  Gene Name: SET-like protein
  ENSP ID: ENSP00000483053
MAPKRQSPLPLQKKKPRPPPALGLEETSASAGLPKKGEKEQQEAIEHIDEVQNEIDRLNEQDSEEILKVEQKYNKLRQPFFQKRSELIAKIPNFGVTTFVNHPQVSSLLGEEDEEALHYLTKVEVTEFEDIKSGYRIDFYFDENPYFENKVFSKEFHLNESGDPSSKSTKIKWKSGKDVTKRSSQTQNKASRKRQHEEPESFFTWFTDHSDAGADELEEVIKDDIWPNPLQYYLVPDMDDEEGGEDDDDDDDDGDEGEEELEDIDEGDEDEGEEDEDDDEGEEGEEDEGEDD

SEQ ID NO: 78413 - protein, 660 aa, Homo sapiens
  Payload ID: 15618
  Gene Symbol: SCMH1
  Gene Name: sex comb on midleg homolog 1 (Drosophila)
  Uniprot ID: Q96GD3
  ENSP ID: ENSP00000318094
MLVCYSVLACEILWDLPCSIMGSPLGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGVLKGSNERRDMESFWKLNRSPGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 78414 - protein, 648 aa, Homo sapiens
  Payload ID: 15618
  Gene Symbol: SCMH1
  Gene Name: sex comb on midleg homolog 1 (Drosophila)
  Uniprot ID: Q96GD3
  ENSP ID: ENSP00000337352
MQPNVIDWSDVRKHKYGHLSESASQYQEAADILDLGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 78415 - protein, 577 aa, Homo sapiens
  Payload ID: 15618
  Gene Symbol: SCMH1
  Gene Name: sex comb on midleg homolog 1 (Drosophila)
  Uniprot ID: Q96GD3
  ENSP ID: ENSP00000354656
MKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 78416 - protein, 591 aa, Homo sapiens
  Payload ID: 15618
  Gene Symbol: SCMH1
  Gene Name: sex comb on midleg homolog 1 (Drosophila)
  Uniprot ID: Q96GD3
  ENSP ID: ENSP00000354996
MQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 78417 - protein, 599 aa, Homo sapiens
  Payload ID: 15618
  Gene Symbol: SCMH1
  Gene Name: sex comb on midleg homolog 1 (Drosophila)
  Uniprot ID: Q96GD3
  ENSP ID: ENSP00000361676
MKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGVLKGSNERRDMESFWKLNRSPGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 78418 - protein, 577 aa, Homo sapiens; identical to SEQ ID NO: 78415
  Payload ID: 15618
  Gene Symbol: SCMH1
  Gene Name: sex comb on midleg homolog 1 (Drosophila)
  Uniprot ID: Q96GD3
  ENSP ID: ENSP00000361677

SEQ ID NO: 78419 - protein, 591 aa, Homo sapiens; identical to SEQ ID NO: 78416
  Payload ID: 15618
  Gene Symbol: SCMH1
  Gene Name: sex comb on midleg homolog 1 (Drosophila)
  Uniprot ID: Q96GD3
  ENSP ID: ENSP00000361678

SEQ ID NO: 78420 - protein, 577 aa, Homo sapiens; identical to SEQ ID NO: 78415
  Payload ID: 15618
  Gene Symbol: SCMH1
  Gene Name: sex comb on midleg homolog 1 (Drosophila)
  Uniprot ID: Q96GD3
  ENSP ID: ENSP00000380356

SEQ ID NO: 78421 - protein, 660 aa, Homo sapiens; identical to SEQ ID NO: 78413
  Payload ID: 15618
  Gene Symbol: SCMH1
  Gene Name: sex comb on midleg homolog 1 (Drosophila)
  Uniprot ID: Q96GD3
  ENSP ID: ENSP00000380359

SEQ ID NO: 78422 - protein, 599 aa, Homo sapiens; identical to SEQ ID NO: 78417
  Payload ID: 15618
  Gene Symbol: SCMH1
  Gene Name: sex comb on midleg homolog 1 (Drosophila)
  Uniprot ID: Q96GD3
  ENSP ID: ENSP00000386079

SEQ ID NO: 78423 - protein, 480 aa, Homo sapiens
  Payload ID: 15618
  Gene Symbol: SCMH1
  Gene Name: sex comb on midleg homolog 1 (Drosophila)
  Uniprot ID: Q96GD3
  ENSP ID: ENSP00000403974
MQSYTPPSNEFKISMKLEAQDPRNTTSTCIATVVGLTGARLRLRLDGSDNKNDFWRLVDSAEIQPIGNCEKNGGMLQPPLVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 78424 - protein, 141 aa, Homo sapiens
  Payload ID: 15618
  Gene Symbol: SCMH1
  Gene Name: sex comb on midleg homolog 1 (Drosophila)
  ENSP ID: ENSP00000479881
VSTSQRHRPLLSSCGLPPSTASAVRRLCSRGVLKGSNERRDMESFWKLNRSPGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 78425 - protein, 329 aa, Homo sapiens
  Payload ID: 15619
  Gene Symbol: SCML1
  Gene Name: sex comb on midleg-like 1 (Drosophila)
  Uniprot ID: Q9UN30
  ENSP ID: ENSP00000369380
MMSNSSSEIDVIKTRIPTYDEDDNTILYAYETKPEFVNKEPNIVSDASCNTEEQLKTVDDVLIHCQVIYDALQNLDKKIDVIRRKVSKIQRFHARSLWTNHKRYGYKKHSYRLVKKLKLQKMKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 78426 - protein, 302 aa, Homo sapiens
  Payload ID: 15619
  Gene Symbol: SCML1
  Gene Name: sex comb on midleg-like 1 (Drosophila)
  Uniprot ID: Q9UN30
  ENSP ID: ENSP00000369382
MMSNSSSEIDVQEPNIVSDASCNTEEQLKTVDDVLIHCQVIYDALQNLDKKIDVIRRKVSKIQRFHARSLWTNHKRYGYKKHSYRLVKKLKLQKMKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 78427 - protein, 208 aa, Homo sapiens
  Payload ID: 15619
  Gene Symbol: SCML1
  Gene Name: sex comb on midleg-like 1 (Drosophila)
  Uniprot ID: Q9UN30
  ENSP ID: ENSP00000369384
MKKNEVYETFSYPESYSPTLPVSRRENNSPSNLPRPSFCMEEYQRAELEEDPILSRTPSPVHPSDFSEHNCQPYYASDGATYGSSSGLCLGNPRADSIHNTYSTDHASAAPPSVTRSPVENDGYIEEGSITKHPSTWSVEAVVLFLKQTDPLALCPLVDLFRSHEIDGKALLLLTSDVLLKHLGVKLGTAVKLCYYIDRLKQGKCFEN

SEQ ID NO: 78428 - protein, 208 aa, Homo sapiens; identical to SEQ ID NO: 78427
  Payload ID: 15619
  Gene Symbol: SCML1
  Gene Name: sex comb on midleg-like 1 (Drosophila)
  Uniprot ID: Q9UN30
  ENSP ID: ENSP00000381154

SEQ ID NO: 78429 - protein, 147 aa, Homo sapiens
  Payload ID: 15619
  Gene Symbol: SCML1
  Gene Name: sex comb on midleg-like 1 (Drosophila)
  ENSP ID: ENSP00000392587
MMSNSSSEIDVQEPNIVSDASCNTEEQLKTVDDVLIHCQVIYDALQNLDKKIDVIRRKVSKIQRFHARSLWTNHKRYGYKKHSYRLVKKLKLQKMKKNEVYETFSYPESYSPTLPVSRRENNSPSNLPRPSFCMEEYQRAELEEDPI

SEQ ID NO: 78430 - protein, 700 aa, Homo sapiens
  Payload ID: 15620
  Gene Symbol: SCML2
  Gene Name: sex comb on midleg-like 2 (Drosophila)
  Uniprot ID: Q9UQR0
  ENSP ID: ENSP00000251900
MGQTVNEDSMDVKKENQEKTPQSSTSSVQRDDFHWEEYLKETGSISAPSECFRQSQIPPVNDFKVGMKLEARDPRNATSVCIATVIGITGARLRLRLDGSDNRNDFWRLVDSPDIQPVGTCEKEGDLLQPPLGYQMNTSSWPMFLLKTLNGSEMASATLFKKEPPKPPLNNFKVGMKLEAIDKKNPYLICPATIGDVKGDEVHITFDGWSGAFDYWCKYDSRDIFPAGWCRLTGDVLQPPGTSVPIVKNIAKTESSPSEASQHSMQSPQKTTLILPTQQVRRSSRIKPPGPTAVPKRSSSVKNITPRKKGPNSGKKEKPLPVICSTSAASLKSLTRDRGMLYKDVASGPCKIVMSTVCVYVNKHGNFGPHLDPKRIQQLPDHFGPGPVNVVLRRIVQACVDCALETKTVFGYLKPDNRGGEVITASFDGETHSIQLPPVNSASFALRFLENFCHSLQCDNLLSSQPFSSSRGHTHSSAEHDKNQSAKEDVTERQSTKRSPQQTVPYVVPLSPKLPKTKEYASEGEPLFAGGSAIPKEENLSEDSKSSSLNSGNYLNPACRNPMYIHTSVSQDFSRSVPGTTSSPLVGDISPKSSPHEVKFQMQRKSEAPSYIAVPDPSVLKQGFSKDPSTWSVDEVIQFMKHTDPQISGPLADLFRQHEIDGKALFLLKSDVMMKYMGLKLGPALKLCYYIEKLKEGKYS

SEQ ID NO: 78431 - protein, 138 aa, Homo sapiens
  Payload ID: 15620
  Gene Symbol: SCML2
  Gene Name: sex comb on midleg-like 2 (Drosophila)
  Uniprot ID: Q9UQR0
  ENSP ID: ENSP00000381126
MYIHTSVSQDFSRSVPGTTSSPLVGDISPKSSPHEVKFQMQRKSEAPSYIAVPDPSVLKQGFSKDPSTWSVDEVIQFMKHTDPQISGPLADLFRQHEIDGKALFLLKSDVMMKYMGLKLGPALKLCYYIEKLKEGKYS

SEQ ID NO: 78432 - protein, 125 aa, Homo sapiens
  Payload ID: 15620
  Gene Symbol: SCML2
  Gene Name: sex comb on midleg-like 2 (Drosophila)
  ENSP ID: ENSP00000407315
  MOD_RES (1)..(1): Any amino acid
XAKEDVTERQSTKRSPQQTVPYVVPLSPKLPKTKEYASEGEPLFAGGSAIPKEENLSEDSKSSSLNSGNYLNPACRNPMYIHTSVSQDFSRSVPGTTSSPLVGDISPKSSPHEVKFQMQRKSEGN

SEQ ID NO: 78433 - protein, 414 aa, Homo sapiens
  Payload ID: 15621
  Gene Symbol: SCML4
  Gene Name: sex comb on midleg-like 4 (Drosophila)
  Uniprot ID: Q8N228
  ENSP ID: ENSP00000358016
MQSQRIPGRKRGRPSLHSTPMKMAVHNLYSASAGSLPAVKIPKKRGRKPGYKIKSRVLMTPLALSPPRSTPEPDLSSIPQDAATVPSLAAPQALTVCLYINKQANAGPYLERKKVQQLPEHFGPERPSAVLQQAVQACIDCAHQQKLVFSLVKQGYGGEMVSVSASFDGKQHLRSLPVVNSIGYVLRFLAKLCRSLLCDDLFSHQPFPRGCSASEKVQEKEEGRMESVKTVTTEEYLVNPVGMNRYSVDTSASTFNHRGSLHPSSSLYCKRQNSGDSHLGGGPAATAGGPRTSPMSSGGPSAPGLRPPASSPKRNTTSLEGNRCASSPSQDAQDARRPRSRNPSAWTVEDVVWFVKDADPQALGPHVELFRKHEIDGNALLLLKSDMVMKYLGLKLGPALKLCYHIDKLKQAKF

SEQ ID NO: 78434 - protein, 305 aa, Homo sapiens
  Payload ID: 15621
  Gene Symbol: SCML4
  Gene Name: sex comb on midleg-like 4 (Drosophila)
  Uniprot ID: Q8N228
  ENSP ID: ENSP00000358017
MPCQRTAWIGCDRQRTPPFHWREIKSRVLMTPLALSPPRSTPEPDLSSIPQDAATVPSLAAPQALTVCLYINKQANAGPYLERKKVQQLPEHFGPERPSAVLQQAVQACIDCAHQQKLVFSLVKQGYGGEMVSVSASFDGKQHLRSLPVVNSIGYVLRFLAKLCRSLLCDDLFSHQPFPRGCSASEKVQEKEEGRMESVKTVTTEEYLVNPVGMNRYSVDTSASTFNHRGSLHPSSSLYCKRQNSGDSHLGGGPAATAGGPRTSPMSSGGPSAPGLRPPASSPKRNTTSLEGNRCGNVMHASASH

SEQ ID NO: 78435 - protein, 356 aa, Homo sapiens
  Payload ID: 15621
  Gene Symbol: SCML4
  Gene Name: sex comb on midleg-like 4 (Drosophila)
  Uniprot ID: Q8N228
  ENSP ID: ENSP00000358018
MTPLALSPPRSTPEPDLSSIPQDAATVPSLAAPQALTVCLYINKQANAGPYLERKKVQQLPEHFGPERPSAVLQQAVQACIDCAHQQKLVFSLVKQGYGGEMVSVSASFDGKQHLRSLPVVNSIGYVLRFLAKLCRSLLCDDLFSHQPFPRGCSASEKVQEKEEGRMESVKTVTTEEYLVNPVGMNRYSVDTSASTFNHRGSLHPSSSLYCKRQNSGDSHLGGGPAATAGGPRTSPMSSGGPSAPGLRPPASSPKRNTTSLEGNRCASSPSQDAQDARRPRSRNPSAWTVEDVVWFVKDADPQALGPHVELFRKHEIDGNALLLLKSDMVMKYLGLKLGPALKLCYHIDKLKQAKF

SEQ ID NO: 78436 - protein, 172 aa, Homo sapiens
  Payload ID: 15621
  Gene Symbol: SCML4
  Gene Name: sex comb on midleg-like 4 (Drosophila)
  ENSP ID: ENSP00000358021
MNRYSVDTSASTFNHRGSLHPSSSLYCKRQNSGDSHLGGGPAATAGGPRTSPMSSGGPSAPGLRPPASSPKRNTTSLEGNRCASSPSQDAQDARRPRSRNPSAWTVEDVVWFVKDADPQALGPHVELFRKHEIDGNALLLLKSDMVMKYLGLKLGPALKLCYHIDKLKQAKF

SEQ ID NO: 78437 - protein, 171 aa, Homo sapiens
  Payload ID: 15621
  Gene Symbol: SCML4
  Gene Name: sex comb on midleg-like 4 (Drosophila)
  ENSP ID: ENSP00000395589
MTPLALSPPRSTPEPDLSSIPQDAATVPSLAAPQALTVCLYINKQANAGPYLERKKVQQLPEHFGPERPSAVLQQAVQACIDCAHQQKLVFSLVKQGYGGEMVSVSASFDGKQHLRSLPVVNSIGYVLRFLAKLCRSLLCDDLFSHQPFPRGCSASEKVQEKEEGRMESGG

SEQ ID NO: 78438 - protein, 198 aa, Homo sapiens
  Payload ID: 15621
  Gene Symbol: SCML4
  Gene Name: sex comb on midleg-like 4 (Drosophila)
  ENSP ID: ENSP00000404688
MPCQRTAWIGCDRQRTPPFHWREIKSRVLMTPLALSPPRSTPEPDLSSIPQDAATVPSLAAPQALTVCLYINKQANAGPYLERKKVQQLPEHFGPERPSAVLQQAVQACIDCAHQQKLVFSLVKQGYGGEMVSVSASFDGKQHLRSLPVVNSIGYVLRFLAKLCRSLLCDDLFSHQPFPRGCSASEKVQEKEEGRMES

SEQ ID NO: 78439 - protein, 204 aa, Homo sapiens
  Payload ID: 15622
  Gene Symbol: SRY
  Gene Name: sex determining region Y
  Uniprot ID: Q05066
  ENSP ID: ENSP00000372547
MQSYASAMLSVFNSDDYSPAVQENIPALRRSSSFLCTESCNSKYQCETGENSKGNVQDRVKRPMNAFIVWSRDQRRKMALENPRMRNSEISKQLGYQWKMLTEAEKWPFFQEAQKLQAMHREKYPNYKYRPRRKAKMLPKNCSLLPADPASVLCSEVQLDNRLYRDDCTKATHSRMEHQLGHLPPINAASSPQQRDRYSHWTKL

SEQ ID NO: 78440 - protein, 344 aa, Homo sapiens
  Payload ID: 15623
  Gene Symbol: SHBG
  Gene Name: sex hormone-binding globulin
  ENSP ID: ENSP00000345675
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 78441 - protein, 402 aa, Homo sapiens
  Payload ID: 15623
  Gene Symbol: SHBG
  Gene Name: sex hormone-binding globulin
  Uniprot ID: P04278
  ENSP ID: ENSP00000369816
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 78442 - protein, 293 aa, Homo sapiens
  Payload ID: 15623
  Gene Symbol: SHBG
  Gene Name: sex hormone-binding globulin
  Uniprot ID: P04278
  ENSP ID: ENSP00000388867
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 78443 - protein, 287 aa, Homo sapiens
  Payload ID: 15623
  Gene Symbol: SHBG
  Gene Name: sex hormone-binding globulin
  Uniprot ID: P04278
  ENSP ID: ENSP00000393426
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 78444 - protein, 235 aa, Homo sapiens
  Payload ID: 15623
  Gene Symbol: SHBG
  Gene Name: sex hormone-binding globulin
  ENSP ID: ENSP00000458181
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 78445 - protein, 181 aa, Homo sapiens
  Payload ID: 15623
  Gene Symbol: SHBG
  Gene Name: sex hormone-binding globulin
  ENSP ID: ENSP00000458199
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAAPETGLWAPDQQTPSHHEDCAWGAALPRFQPSVAAGSCPGWLPAPGFLAGQTGRDLSICPH

SEQ ID NO: 78446 - protein, 344 aa, Homo sapiens; identical to SEQ ID NO: 78440
  Payload ID: 15623
  Gene Symbol: SHBG
  Gene Name: sex hormone-binding globulin
  ENSP ID: ENSP00000458559

SEQ ID NO: 78447 - protein, 93 aa, Homo sapiens
  Payload ID: 15623
  Gene Symbol: SHBG
  Gene Name: sex hormone-binding globulin
  ENSP ID: ENSP00000458719
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVL

SEQ ID NO: 78448 - protein, 82 aa, Homo sapiens
  Payload ID: 15623
  Gene Symbol: SHBG
  Gene Name: sex hormone-binding globulin
  ENSP ID: ENSP00000458816
MTFDLTKITKTSSSFEVRTWDPEGVIFYGDTNPKDDWFMLGLRDGRPEIQLHNHWAQLTVGAGPRLDDGRWHQEKTLPPLFA

SEQ ID NO: 78449 - protein, 212 aa, Homo sapiens
  Payload ID: 15623
  Gene Symbol: SHBG
  Gene Name: sex hormone-binding globulin
  ENSP ID: ENSP00000458858
WALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 78450 - protein, 229 aa, Homo sapiens
  Payload ID: 15623
  Gene Symbol: SHBG
  Gene Name: sex hormone-binding globulin
  ENSP ID: ENSP00000458875
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 78451 - protein, 384 aa, Homo sapiens
  Payload ID: 15623
  Gene Symbol: SHBG
  Gene Name: sex hormone-binding globulin
  Uniprot ID: P04278
  ENSP ID: ENSP00000458973
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 78452 - protein, 181 aa, Homo sapiens
  Payload ID: 15623
  Gene Symbol: SHBG
  Gene Name: sex hormone-binding globulin
  ENSP ID: ENSP00000459620
MTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 78453 - protein, 113 aa, Homo sapiens
  Payload ID: 15623
  Gene Symbol: SHBG
  Gene Name: sex hormone-binding globulin
  ENSP ID: ENSP00000459826
WALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQEKTLPPLFA

SEQ ID NO: 78454 - protein, 290 aa, Homo sapiens
  Payload ID: 15623
  Gene Symbol: SHBG
  Gene Name: sex hormone-binding globulin
  ENSP ID: ENSP00000459999
MTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 78455 - protein, 260 aa, Homo sapiens
  Payload ID: 15623
  Gene Symbol: SHBG
  Gene Name: sex hormone-binding globulin
  ENSP ID: ENSP00000460219
WALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 78456 - protein, 175 aa, Homo sapiens
  Payload ID: 15623
  Gene Symbol: SHBG
  Gene Name: sex hormone-binding globulin
  ENSP ID: ENSP00000461133
MTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 78457 - protein, 57 aa, Homo sapiens
  Payload ID: 15623
  Gene Symbol: SHBG
  Gene Name: sex hormone-binding globulin
  ENSP ID: ENSP00000461162
MESRGPLATSRLLLLLLLLLLRHTRQGWALRPVLPTQVQERDRALSSCSLPFSPLAL

SEQ ID NO: 78458 - protein, 206 aa, Homo sapiens
  Payload ID: 15623
  Gene Symbol: SHBG
  Gene Name: sex hormone-binding globulin
  ENSP ID: ENSP00000461743
WALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 78459 - protein, 1242 aa, Homo sapiens
  Payload ID: 15624
  Gene Symbol: SFI1
  Gene Name: SFI1 centrin binding protein
  Uniprot ID: A8K8P3
  ENSP ID: ENSP00000383145
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 78460 - protein, 1160 aa, Homo sapiens
  Payload ID: 15624
  Gene Symbol: SFI1
  Gene Name: SFI1 centrin binding protein
  Uniprot ID: A8K8P3
  ENSP ID: ENSP00000383146
MKNLLTEKCISSHNFHQKVIKQRMEKKVDSRFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 78461 - protein, 149 aa, Homo sapiens
  Payload ID: 15624
  Gene Symbol: SFI1
  Gene Name: SFI1 centrin binding protein
  ENSP ID: ENSP00000389364
KKSSASFGIRRELPSTSHLVQYRGTHTCTRQGRLRELRIRCVARKFLYLWIRMTFGRVFPSKARYYLYNLMFQTWKTYVRQQQEMRNKYIRAEVHDAKQKMRQAWKSWLIYVVVRRTKLQMQTTALEFRQRIILRVWWSTWRQRLGQVR

SEQ ID NO: 78462 - protein, 102 aa, Homo sapiens
  Payload ID: 15624
  Gene Symbol: SFI1
  Gene Name: SFI1 centrin binding protein
  ENSP ID: ENSP00000391339
MKNLLTEKCISSHNFHQKVIKQRMEKKVDSRYFKDGAVKKPYSAKTLSNKKSSASFGIRRELPSTSHLVQYRGTHTCTRQGRLRELRIRGSQCRGNDRHPVS

SEQ ID NO: 78463 - protein, 605 aa, Homo sapiens
  Payload ID: 15624
  Gene Symbol: SFI1
  Gene Name: SFI1 centrin binding protein
  ENSP ID: ENSP00000398871
YFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRETYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQ

SEQ ID NO: 78464 - protein, 1089 aa, Homo sapiens
  Payload ID: 15624
  Gene Symbol: SFI1
  Gene Name: SFI1 centrin binding protein
  ENSP ID: ENSP00000401199
MKNLLTEKCISSHNFHQKVIKQRMEKKVDSRFYYEQRLLRKVFEEWKEEWWVFQHEWKLCVRADCHYRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 78465 - protein, 1211 aa, Homo sapiens
  Payload ID: 15624
  Gene Symbol: SFI1
  Gene Name: SFI1 centrin binding protein
  Uniprot ID: A8K8P3
  ENSP ID: ENSP00000402679
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 78466 - protein, 489 aa, Homo sapiens
  Payload ID: 15624
  Gene Symbol: SFI1
  Gene Name: SFI1 centrin binding protein
  ENSP ID: ENSP00000405541
  MOD_RES (1)..(1): Any amino acid
XEYLQVRRVKRQQNEMAERFHHVTVLQIYFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTESWSSGGKLCQCRCITDSRRTVPSGRPRRCWTGAVCGPGFSAGGTAAGGQPSRDCSWRGQCNTTTGSCCWRGWPGGRRTICSVSGRGSCTGRAPNCWHRDSAGPASASGDNSWQPGGRSSGRQCGPCGSGPSRCRQRCGPRGWPLYWKGGERRRGCSGRSRPTRGSSSRRVPRGSCALQPA

SEQ ID NO: 78467 - protein, 79 aa, Homo sapiens
  Payload ID: 15624
  Gene Symbol: SFI1
  Gene Name: SFI1 centrin binding protein
  ENSP ID: ENSP00000411793
MKNLLTEKCISSHNFHQKVIKQRMEKKVDSRYFKDGAVKKPYSAKTLSNKKSSASFGIRRELPSTSHLVQYRGTHTCTR

SEQ ID NO: 78468 - protein, 57 aa, Homo sapiens
  Payload ID: 15624
  Gene Symbol: SFI1
  Gene Name: SFI1 centrin binding protein
  ENSP ID: ENSP00000416931
  MOD_RES (1)..(1): Any amino acid
XQIEQKKERELLPLLHAAWDHYRIALLCKCIELWLQYTQKRRYKQVSLCHPGWSTVA

SEQ ID NO: 78469 - protein, 389 aa, Homo sapiens
  Payload ID: 15624
  Gene Symbol: SFI1
  Gene Name: SFI1 centrin binding protein
  ENSP ID: ENSP00000430488
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNAATGQSGWSFPAESPACCLPHMEQTLAMAPPGKCPQCKSNTFPQGDIREASIFSLEAEDVSASRKPPGRENGHPSRRATASV

SEQ ID NO: 78470 - protein, 1187 aa, Homo sapiens
  Payload ID: 15624
  Gene Symbol: SFI1
  Gene Name: SFI1 centrin binding protein
  Uniprot ID: A8K8P3
  ENSP ID: ENSP00000443025
MKNLLTEKCISSHNFHQKVIKQRMEKKVDSRYFKDGAVKKPYSAKTLSNKKSSASFGIRRELPSTSHLVQYRGTHTCTRQGRLRELRIRFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 78471 - protein, 102 aa, Homo sapiens; identical to SEQ ID NO: 78462
  Payload ID: 15624
  Gene Symbol: SFI1
  Gene Name: SFI1 centrin binding protein
  ENSP ID: ENSP00000485935

SEQ ID NO: 78472 - protein, 159 aa, Homo sapiens
  Payload ID: 15625
  Gene Symbol: SFT2D1
  Gene Name: SFT2 domain containing 1
  Uniprot ID: Q8WV19
  ENSP ID: ENSP00000354590
MEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLLCFIFTLCAALWWHKKGLAVLFCILQFLSMTWYSLSYIPYARDAVIKCCSSLLS

SEQ ID NO: 78473 - protein, 160 aa, Homo sapiens
  Payload ID: 15626
  Gene Symbol: SFT2D2
  Gene Name: SFT2 domain containing 2
  Uniprot ID: O95562
  ENSP ID: ENSP00000271375
MDKLKKVLSGQDTEDRSGLSEVVEASSLSWSTRIKGFIACFAIGILCSLLGTVLLWVPRKGLHLFAVFYTFGNIASIGSTIFLMGPVKQLKRMFEPTRLIATIMVLLCFALTLCSAFWWHNKGLALIFCILQSLALTWYSLSFIPFARDAVKKCFAVCLA

SEQ ID NO: 78474 - protein, 108 aa, Homo sapiens
  Payload ID: 15626
  Gene Symbol: SFT2D2
  Gene Name: SFT2 domain containing 2
  ENSP ID: ENSP00000356803
MDKLKKVLSGQDTEDRSGLSEVVEASSLSWSTRIKGFIACFAIGILCSLLGTVLLWVPRKGLHLFAVFYTFGNIASIGSCVLHLPCVLPFGGITRDLHLSSAFCSLWH

SEQ ID NO: 78475 - protein, 108 aa, Homo sapiens; identical to SEQ ID NO: 78474
  Payload ID: 15626
  Gene Symbol: SFT2D2
  Gene Name: SFT2 domain containing 2
  ENSP ID: ENSP00000486492

SEQ ID NO: 78476 - protein, 215 aa, Homo sapiens
  Payload ID: 15627
  Gene Symbol: SFT2D3
  Gene Name: SFT2 domain containing 3
  Uniprot ID: Q587I9
  ENSP ID: ENSP00000310803
MADLHRQLQEYLAQGKAGGPAAAEPLLAAEKAEEPGDRPAEEWLGRAGLRWTWARSPAESAAAGLTCLPSVTRGQRLAAGGGCLLLAALCFGLAALYAPVLLLRARKFALLWSLGSALALAGSALLRGGAACGRLLRCEEAPSRPALLYMAALGATLFAALGLRSTLLTVLGAGAQVAALLAALVGLLPWGGGTALRLALGRLGRGAGLAKVLPV

SEQ ID NO: 78477 - protein, 333 aa, Homo sapiens
  Payload ID: 15628
  Gene Symbol: SUGT1
  Gene Name: SGT1 homolog, MIS12 kinetochore complex assembly cochaperone
  Uniprot ID: Q9Y2Z0
  ENSP ID: ENSP00000308067
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDSADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 78478 - protein, 365 aa, Homo sapiens
  Payload ID: 15628
  Gene Symbol: SUGT1
  Gene Name: SGT1 homolog, MIS12 kinetochore complex assembly cochaperone
  Uniprot ID: Q9Y2Z0
  ENSP ID: ENSP00000367208
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDIETGFHRVGQAGLQLLTSSDPPALDSQSAGITGADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 78479 - protein, 125 aa, Homo sapiens
  Payload ID: 15629
  Gene Symbol: SH2D1A
  Gene Name: SH2 domain containing 1A
  Uniprot ID: O60880
  ENSP ID: ENSP00000353126
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGIREDPDVCLKAP

SEQ ID NO: 78480 - protein, 128 aa, Homo sapiens
  Payload ID: 15629
  Gene Symbol: SH2D1A
  Gene Name: SH2 domain containing 1A
  Uniprot ID: O60880
  ENSP ID: ENSP00000360181
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGTTGIREDPDVCLKAP

SEQ ID NO: 78481 - protein, 76 aa, Homo sapiens
  Payload ID: 15629
  Gene Symbol: SH2D1A
  Gene Name: SH2 domain containing 1A
  Uniprot ID: O60880
  ENSP ID: ENSP00000477094
MDAVAVYHGKISRETGEKLLLATGLDGSYLLRDSESVPGITVTFIHTECPRQKQVLGVLSISEARSRHCNTSAVSS

SEQ ID NO: 78482 - protein, 132 aa, Homo sapiens
  Payload ID: 15630
  Gene Symbol: SH2D1B
  Gene Name: SH2 domain containing 1B
  Uniprot ID: O14796
  ENSP ID: ENSP00000356906
MDLPYYHGRLTKQDCETLLLKEGVDGNFLLRDSESIPGVLCLCVSFKNIVYTYRIFREKHGYYRIQTAEGSPKQVFPSLKELISKFEKPNQGMVVHLLKPIKRTSPSLRWRGLKLELETFVNSNSDYVDVLP

SEQ ID NO: 78483 - protein, 371 aa, Homo sapiens
  Payload ID: 15631
  Gene Symbol: SH2D2A
  Gene Name: SH2 domain containing 2A
  Uniprot ID: Q9NP31
  ENSP ID: ENSP00000357181
MSPSTFQITDMTRRSCQNLGYTAASPQAPEAASNTGNAERAEEVPGEGSLFLQAETRAWFQKTQAHWLLQHGAAPAWFHGFITRREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 78484 - protein, 389 aa, Homo sapiens
  Payload ID: 15631
  Gene Symbol: SH2D2A
  Gene Name: SH2 domain containing 2A
  Uniprot ID: Q9NP31
  ENSP ID: ENSP00000357182
MEFPLAQICPQGSHEAPIPTFSTFQITDMTRRSCQNLGYTAASPQAPEAASNTGNAERAEEVPGEGSLFLQAETRAWFQKTQAHWLLQHGAAPAWFHGFITRREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 78485 - protein, 399 aa, Homo sapiens
  Payload ID: 15631
  Gene Symbol: SH2D2A
  Gene Name: SH2 domain containing 2A
  Uniprot ID: Q9NP31
  ENSP ID: ENSP00000376123
MEFPLAQICPQGSHEAPIPTFSTFQITDMTRRSCQNLGYTAASPQAPEAASNTGNAERAEEVPGEGSLFLQAETRAWFQKTQAHWLLQHGAAPAWFHGFITRRVRPPLSVTHREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 78486 - protein, 576 aa, Homo sapiens
  Payload ID: 15632
  Gene Symbol: SH2D3A
  Gene Name: SH2 domain containing 3A
  Uniprot ID: Q9BRG2
  ENSP ID: ENSP00000245908
MQVPQDGEDLAGQPWYHGLLSRQKAEALLQQNGDFLVRASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMEASTMPISALPRTSSDPVLLKAPAPLGTVADSLRASDGQLQAKAPTKPPRTPSFELPDASERPPTYCELVPRVPSVQGTSPSQSCPEPEAPWWEAEEDEEEENRCFTRPQAEISFCPHDAPSCLLGPQNRPLEPQVLHTLRGLFLEHHPGSTALHLLLVDCQATGLLGVTRDQRGNMGVSSGLELLTLPHGHHLRLELLERHQTLALAGALAVLGCSGPLEERAAALRGLVELALALRPGAAGDLPGLAAVMGALLMPQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGFRPNPELREALTTGFVRRLLWGSRGAGAPRAERFEKFQRVLGVLSQRLEPDR

SEQ ID NO: 78487 - protein, 483 aa, Homo sapiens
  Payload ID: 15632
  Gene Symbol: SH2D3A
  Gene Name: SH2 domain containing 3A
  Uniprot ID: Q9BRG2
  ENSP ID: ENSP00000393303
MEKTLLANLGTTASCPARARKWSNSQPADLAHMGRSREDPAGMEASTMPISALPRTSSDPVLLKAPAPLGTVADSLRASDGQLQAKAPTKPPRTPSFELPDASERPPTYCELVPRVPSVQGTSPSQSCPEPEAPWWEAEEDEEEENRCFTRPQAEISFCPHDAPSCLLGPQNRPLEPQVLHTLRGLFLEHHPGSTALHLLLVDCQATGLLGVTRDQRGNMGVSSGLELLTLPHGHHLRLELLERHQTLALAGALAVLGCSGPLEERAAALRGLVELALALRPGAAGDLPGLAAVMGALLMPQVRGEQGLEEAGVRVTGKTGEEACSDLFSQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGFRPNPELREALTTGFVRRLLWGSRGAGAPRAERFEKFQRVLGVLSQRLEPDR

SEQ ID NO: 78488 - protein, 238 aa, Homo sapiens
  Payload ID: 15632
  Gene Symbol: SH2D3A
  Gene Name: SH2 domain containing 3A
  ENSP ID: ENSP00000470700
MQVPQDGEDLAGQPWYHGLLSRQKAEALLQQNGDFLVRASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMESAPGTPSPAYPPWPVPGAPSWEHRPSPAIGRLPGHRPPGSDQRSAGQHGSLIWPGAAHSSPWTPLEVGTAGE

SEQ ID NO: 78489 - protein, 860 aa, Homo sapiens
  Payload ID: 15633
  Gene Symbol: SH2D3C
  Gene Name: SH2 domain containing 3C
  Uniprot ID: Q8N5H7
  ENSP ID: ENSP00000317817
MTEGTKKTSKKFKFFKFKGFGSLSNLPRSFTLRRSSASISRQSHLEPDTFEATQDDMVTVPKSPPAYARSSDMYSHMGTMPRPSIKKAQNSQAARQAQEAGPKPNLVPGGVPDPPGLEAAKEVMVKATGPLEDTPAMEPNPSAVEVDPIRKPEVPTGDVEEERPPRDVHSERAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 78490 - protein, 792 aa, Homo sapiens
  Payload ID: 15633
  Gene Symbol: SH2D3C
  Gene Name: SH2 domain containing 3C
  Uniprot ID: Q8N5H7
  ENSP ID: ENSP00000362373
MAPALPSPHKAVARPELLLDTAAHSGKLRAPDGGEGAECAGHNGGPSWGVGQGQSQEPSRQGIPQAPWLVSWQRRGFPPSSFCPGPLRTEKLRAGRCPLLLCGGAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 78491 - protein, 703 aa, Homo sapiens
  Payload ID: 15633
  Gene Symbol: SH2D3C
  Gene Name: SH2 domain containing 3C
  Uniprot ID: Q8N5H7
  ENSP ID: ENSP00000362374
MTAVGRRCPALGSRGAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 78492 - protein, 702 aa, Homo sapiens
  Payload ID: 15633
  Gene Symbol: SH2D3C
  Gene Name: SH2 domain containing 3C
  Uniprot ID: Q8N5H7
  ENSP ID: ENSP00000388536
MTERCSLWSALSAAACCFYRGSFVQVQFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 78493 - protein, 506 aa, Homo sapiens
  Payload ID: 15633
  Gene Symbol: SH2D3C
  Gene Name: SH2 domain containing 3C
  Uniprot ID: Q8N5H7
  ENSP ID: ENSP00000394632
MKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 78494 - protein, 134 aa, Homo sapiens
  Payload ID: 15633
  Gene Symbol: SH2D3C
  Gene Name: SH2 domain containing 3C
  ENSP ID: ENSP00000401641
MKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYS

SEQ ID NO: 78495 - protein, 196 aa, Homo sapiens
  Payload ID: 15633
  Gene Symbol: SH2D3C
  Gene Name: SH2 domain containing 3C
  ENSP ID: ENSP00000413760
MPFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPT

SEQ ID NO: 78496 - protein, 700 aa, Homo sapiens
  Payload ID: 15633
  Gene Symbol: SH2D3C
  Gene Name: SH2 domain containing 3C
  Uniprot ID: Q8N5H7
  ENSP ID: ENSP00000485866
MTERCSLWSALSAAACCFYRGSFVQFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 78497 - protein, 454 aa, Homo sapiens
  Payload ID: 15634
  Gene Symbol: SH2D4A
  Gene Name: SH2 domain containing 4A
  Uniprot ID: Q9H788
  ENSP ID: ENSP00000265807
MLKQILSEMYIDPDLLAELSEEQKQILFFKMREEQIRRWKEREAAMERKESLPVKPRPKKENGKSVHWKLGADKEVWVWVMGEHHLDKPYDVLCNEIIAERARLKAEQEAEEPRKTHSEEFTNSLKTKSQYHDLQAPDNQQTKDIWKKVAEKEELEQGSRPAPTLEEEKIRSLSSSSRNIQQMLADSINRMKAYAFHQKKESMKKKQDEEINQIEEERTKQICKSWKEDSEWQASLRKSKAADEKRRSLAKQAREDYKRLSLGAQKGRGGERLQSPLRVPQKPERPPLPPKPQFLNSGAYPQKPLRNQGVVRTLSSSAQEDIIRWFKEEQLPLRAGYQKTSDTIAPWFHGILTLKKANELLLSTGMPGSFLIRVSERIKGYALSYLSEDGCKHFLIDASADAYSFLGVDQLQHATLADLVEYHKEEPITSLGKELLLYPCGQQDQLPDYLELFE

SEQ ID NO: 78498 - protein, 189 aa, Homo sapiens
  Payload ID: 15634
  Gene Symbol: SH2D4A
  Gene Name: SH2 domain containing 4A
  ENSP ID: ENSP00000428048
LLAELSEEQKQILFFKMREEQIRRWKEREAAMERKESLPVKPRPKKENGKSVHWKLGADKEVWVWVMGEHHLDKPYDVLCNEIIAERARLKAEQEAEEPRKTHSEEFTNSLKTKSQYHDLQAPDNQQTKDIWKKVAEKEELEQGSRPAPTLEEEKIRKKESMKKKQDEEINQIEEERTKQICKSWKEDS

SEQ ID NO: 78499 - protein, 454 aa, Homo sapiens; identical to SEQ ID NO: 78497
  Payload ID: 15634
  Gene Symbol: SH2D4A
  Gene Name: SH2 domain containing 4A
  Uniprot ID: Q9H788
  ENSP ID: ENSP00000428684

SEQ ID NO: 78500 - protein, 409 aa, Homo sapiens
  Payload ID: 15634
  Gene Symbol: SH2D4A
  Gene Name: SH2 domain containing 4A
  Uniprot ID: Q9H788
  ENSP ID: ENSP00000429482
MWRVIEPPCPGAPSTENGKSVHWKLGADKEVWVWVMGEHHLDKPYDVLCNEIIAERARLKAEQEAEEPRKTHSEEFTNSLKTKSQYHDLQAPDNQQTKDIWKKVAEKEELEQGSRPAPTLEEEKIRSLSSSSRNIQQMLADSINRMKAYAFHQKKESMKKKQDEEINQIEEERTKQICKSWKEDSEWQASLRKSKAADEKRRSLAKQAREDYKRLSLGAQKGRGGERLQSPLRVPQKPERPPLPPKPQFLNSGAYPQKPLRNQGVVRTLSSSAQEDIIRWFKEEQLPLRAGYQKTSDTIAPWFHGILTLKKANELLLSTGMPGSFLIRVSERIKGYALSYLSEDGCKHFLIDASADAYSFLGVDQLQHATLADLVEYHKEEPITSLGKELLLYPCGQQDQLPDYLELFE

SEQ ID NO: 78501 - protein, 309 aa, Homo sapiens
  Payload ID: 15635
  Gene Symbol: SH2D4B
  Gene Name: SH2 domain containing 4B
  Uniprot ID: Q5SQS7
  ENSP ID: ENSP00000314242
MLPEDSGGSPDAAASDKHIQWLLGADGEVWVWIMGEGPGDKPYEEISEELIAERARLQAQREAEELWRQKEAEITKKFRDALANEKARILAEKWKVEMEDRKAAKVLEERIHEEFKRKEEEERKRGEEQIRLQEEQRAKELYWTLKQAQLHCQASEKEEREWEEQLRRSKAADEERSRRAQRARDEYRHHSLRAIQKGTVAGLSSMFRELGQSHEQEARLYHHLPDPGLPQPLALPVSRTWERPLRPVSRDVIVRWFKEEQLPRRAGFERNTKFIAPWFHGGNYHCFRRRVTSGTLRTEGQPTRLPSVV

SEQ ID NO: 78502 - protein, 357 aa, Homo sapiens
  Payload ID: 15635
  Gene Symbol: SH2D4B
  Gene Name: SH2 domain containing 4B
  Uniprot ID: Q5SQS7
  ENSP ID: ENSP00000345295
MLQQILHDMYIDPELLAELSDVQKHILFYKMREEQLRRWKERETWEALAQDEGLRPPKTKRAASDKHIQWLLGADGEVWVWIMGEGPGDKPYEEISEELIAERARLQAQREAEELWRQKEAEITKKFRDALANEKARILAEKWKVEMEDRKAAKVLEERIHEEFKRKEEEERKRGEEQIRLQEEQRAKELYWTLKQAQLHCQASEKEEREWEEQLRRSKAADEERSRRAQRARDEYRHHSLRAIQKGTVAGLSSMFRELGQSHEQEARLYHHLPDPGLPQPLALPVRTWERPLRPVSRDVIVRWFKEEQLPRRAGFERNTKFIAPWFHGGNYHCFRRRVTSGTLRTEGQPTRLPSVV

SEQ ID NO: 78503 - protein, 339 aa, Homo sapiens
  Payload ID: 15636
  Gene Symbol: SH2D5
  Gene Name: SH2 domain containing 5
  Uniprot ID: Q6ZV89
  ENSP ID: ENSP00000364171
MAHALRRILYSTWCPADCQFAFMARNPRSPASKLFCHLFVGSQPGEVQILHLLLCRSFQLAYLLQHPEERAQPEPCPGPTGEVPLKPLSSSGGLVREPFGRDQLSQNVHALVSFRRLPAEGLVGSGKELPESEGRARHARLGNPYCSPTLVRKKAIRSKVIRSGAYRGCTYETQLQLSAREAFPAAWEAWPRGPGGHSCLVESEGSLTENIWAFAGISRPCALALLRRDVLGAFLLWPELGASGQWCLSVRTQCGVVPHQVFRNHLGRYCLEHLPAEFPSLEALVENHAVTERSLFCPLDMGRLNPTYEEQDCGPPGRPPRTLRPLSHAKSEAELQGLG

SEQ ID NO: 78504 - protein, 423 aa, Homo sapiens
  Payload ID: 15636
  Gene Symbol: SH2D5
  Gene Name: SH2 domain containing 5
  Uniprot ID: Q6ZV89
  ENSP ID: ENSP00000406026
MQKAGAGGRRASDCGLAPHRPRCITKFAQYVGSFPVDDLDTQESVWLVQQQLWALKDCPRRRAVILKFSLQGLKIYSGEGEVLLMAHALRRILYSTWCPADCQFAFMARNPRSPASKLFCHLFVGSQPGEVQILHLLLCRSFQLAYLLQHPEERAQPEPCPGPTGEVPLKPLSSSGGLVREPFGRDQLSQNVHALVSFRRLPAEGLVGSGKELPESEGRARHARLGNPYCSPTLVRKKAIRSKVIRSGAYRGCTYETQLQLSAREAFPAAWEAWPRGPGGHSCLVESEGSLTENIWAFAGISRPCALALLRRDVLGAFLLWPELGASGQWCLSVRTQCGVVPHQVFRNHLGRYCLEHLPAEFPSLEALVENHAVTERSLFCPLDMGRLNPTYEEQDCGPPGRPPRTLRPLSHAKSEAELQGLG

SEQ ID NO: 78505 - protein, 134 aa, Homo sapiens
  Payload ID: 15636
  Gene Symbol: SH2D5
  Gene Name: SH2 domain containing 5
  ENSP ID: ENSP00000408509
MQKAGAGGRRASDCGLAPHRPRCITKFAQYVGSFPVDDLDTQESVWLVQQQLWALKVGGLGGHFPSGSHSLEDQVLLMAHALRRILYSTWCPADCQFAFMARNPRSPASKLFCHLFVGSQPGEVQILHLLLCRS

SEQ ID NO: 78506 - protein, 131 aa, Homo sapiens
  Payload ID: 15636
  Gene Symbol: SH2D5
  Gene Name: SH2 domain containing 5
  ENSP ID: ENSP00000428153
MQKAGAGGRRASDCGLAPHRPRCITKFAQYVGSFPVDDLDTQESVWLVQQQLWALKDCPRRRAVILKFSLQGLKIYSGEGEVLLMAHALRRILYSTWCPADCQFAFMARNPRSPASKLFCHLFVGSQPGEV

SEQ ID NO: 78507 - protein, 126 aa, Homo sapiens
  Payload ID: 15636
  Gene Symbol: SH2D5
  Gene Name: SH2 domain containing 5
  ENSP ID: ENSP00000428656
MQKAGAGGRRASDCGLAPHRPRCITKFAQYVGSFPVDDLDTQESVWLVQQQLWALKDCPRRRAVILKFSLQGLKIYSGEGEVLLMAHALRRILYSTWCPADCQFAFMARNPRSPASKLFCHLFVGS

SEQ ID NO: 78508 - protein, 70 aa, Homo sapiens
  Payload ID: 15636
  Gene Symbol: SH2D5
  Gene Name: SH2 domain containing 5
  ENSP ID: ENSP00000430115
MQKAGAGGRRASDCGLAPHRPRCITKFAQYVGSFPVDDLDTQESVWLVQQQLWALKDCPRRRAVILKFSL

SEQ ID NO: 78509 - protein, 175 aa, Homo sapiens
  Payload ID: 15637
  Gene Symbol: SH2D6
  Gene Name: SH2 domain containing 6
  Uniprot ID: Q7Z4S9
  ENSP ID: ENSP00000341867
MYASSYPPPPQLSPRSHLCPPPPHPTPPQLNNLLLLEGRKSSLPSVAPTGSASAAEDSDLLTQPWYSGNCDRYAVESALLHLQKDGAYTVRPSSGPHGSQPFTLAVLLRGRVFNIPIRRLDGGRHYALGREGRNREELFSSVAAMVQHFMWHPLPLVDRHSGSRELTCLLFPTKP

SEQ ID NO: 78510 - protein, 143 aa, Homo sapiens
  Payload ID: 15637
  Gene Symbol: SH2D6
  Gene Name: SH2 domain containing 6
  Uniprot ID: Q7Z4S9
  ENSP ID: ENSP00000374588
MPSGPLPRTSVVPRPTTAPQETRNGTADAASKEGRKSSLPSVAPTGSASAAEDGAYTVRPSSGPHGSQPFTLAVLLRGRVFNIPIRRLDGGRHYALGREGRNREELFSSVAAMVQHFMWHPLPLVDRHSGSRELTCLLFPTKP

SEQ ID NO: 78511 - protein, 451 aa, Homo sapiens
  Payload ID: 15638
  Gene Symbol: SH2D7
  Gene Name: SH2 domain containing 7
  Uniprot ID: A6NKC9
  ENSP ID: ENSP00000327846
MEDSLKQLSLGRDPEGAGDSQALAELQELALKWFMETQAPFILQNGALPPWFHGFITRKQTEQLLRDKALGSFLIRLSDRATGYILSYRGSDRCRHFVINQLRNRRYIISGDTQSHSTLAELVHHYQEAQLEPFKEMLTAACPRPEDNDLYDAITRGLHQTIVDPENPPATAFLTVVPDKAASPRSSPKPQVSFLHAQKSLDVSPRNLSQEESMEAPIRVSPLPEKSSSLLEESFGGPSDIIYADLRRMNQARLGLGTEGSGRHGPVPAGSQAYSPGREAQRRLSDGEQNRPDGLGPVLSGVSPDQGPTESPTSWGCSDAMGSLGATWRQEFPKLSQEAQPCSQGSSADIYEFIGTEGLLQEARDTPDQEGSTYEQIPACWGGPARAPHPGASPTYSPWVHGYKRISGTPELSEPGNTYEQIPATKSKETGRTHKPDKLRRLFFTYRKHKF

SEQ ID NO: 78512 - protein, 315 aa, Homo sapiens
  Payload ID: 15638
  Gene Symbol: SH2D7
  Gene Name: SH2 domain containing 7
  ENSP ID: ENSP00000386676
MLTAACPRPEDNDLYDAITRGLHQTIVDPENPPATAFLTVVPDKAASPRSSPKPQVSFLHAQKSLDVSPRNLSQEESMEAPIRVSPLPEKSSSLLEESFGGPSDIIYADLRRMNQARLGLGTEGSGRHGPVPAGSQAYSPGREAQRRLSDGEQNRPDGLGPVLSGVSPDQGPTESPTSWGCSDAMGSLGATWRQEFPKLSQEAQPCSQGSSADIYEFIGTEGLLQEARDTPDQEGSTYEQIPACWGGPARAPHPGASPTYSPWVHGYKRISGTPELSEPGNTYEQIPATKSKETGRTHKPDKLRRLFFTYRKHKF

SEQ ID NO: 78513 - protein, 756 aa, Homo sapiens
  Payload ID: 15639
  Gene Symbol: SH2B1
  Gene Name: SH2B adaptor protein 1
  Uniprot ID: Q9NRF2
  ENSP ID: ENSP00000321221
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQEPTTSHDPPQPPEPPSWTDPPQPGAEEASRAPEVAAAAAAAAKERQEKEKAGGGGVPEELVPVVELVPVVELEEAIAPGSEAQGAGSGGDAGVPPMVQLQQSPLGGDGEEGGHPRAINNQYSFV

SEQ ID NO: 78514 - protein, 671 aa, Homo sapiens
  Payload ID: 15639
  Gene Symbol: SH2B1
  Gene Name: SH2B adaptor protein 1
  Uniprot ID: Q9NRF2
  ENSP ID: ENSP00000337163
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 78515 - protein, 683 aa, Homo sapiens
  Payload ID: 15639
  Gene Symbol: SH2B1
  Gene Name: SH2B adaptor protein 1
  Uniprot ID: Q9NRF2
  ENSP ID: ENSP00000352232
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGEQSRSAGEEVPVHPRSEAGSRLGAMRGCAREMDATPMPPAPSCPSERVTV

SEQ ID NO: 78516 - protein, 671 aa, Homo sapiens; identical to SEQ ID NO: 78514
  Payload ID: 15639
  Gene Symbol: SH2B1
  Gene Name: SH2B adaptor protein 1
  Uniprot ID: Q9NRF2
  ENSP ID: ENSP00000378903

SEQ ID NO: 78517 - protein, 335 aa, Homo sapiens
  Payload ID: 15639
  Gene Symbol: SH2B1
  Gene Name: SH2B adaptor protein 1
  ENSP ID: ENSP00000438784
MPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 78518 - protein, 373 aa, Homo sapiens
  Payload ID: 15639
  Gene Symbol: SH2B1
  Gene Name: SH2B adaptor protein 1
  ENSP ID: ENSP00000440354
MAEASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGEQSRSAGEEVPVHPRSEAGSRLGAMRGCAREMDATPMPPAPSCPSERVTV

SEQ ID NO: 78519 - protein, 122 aa, Homo sapiens
  Payload ID: 15639
  Gene Symbol: SH2B1
  Gene Name: SH2B adaptor protein 1
  ENSP ID: ENSP00000454601
MPDRENTFVVKVEGPSEYIMETVDAQHVKAWVSDIQECLSPGENTDSLELSCLNHSESLPSQDLLLGPSESNDRLSQGAYGGLSDRPSASISPSSASIAASHFDSMELLPPELPPRIPIEEG

SEQ ID NO: 78520 - protein, 18 aa, Homo sapiens
  Payload ID: 15639
  Gene Symbol: SH2B1
  Gene Name: SH2B adaptor protein 1
  ENSP ID: ENSP00000455236
MTLPLAPGTSFLTRENTD

SEQ ID NO: 78521 - protein, 182 aa, Homo sapiens
  Payload ID: 15639
  Gene Symbol: SH2B1
  Gene Name: SH2B adaptor protein 1
  ENSP ID: ENSP00000455534
SAGPLETSSGPPVLDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPTGTVHPLSAPYP

SEQ ID NO: 78522 - protein, 56 aa, Homo sapiens
  Payload ID: 15639
  Gene Symbol: SH2B1
  Gene Name: SH2B adaptor protein 1
  ENSP ID: ENSP00000457214
MNGAPSPEDGASPSSPPLPPPPPPSWREFCESHARAAALDFARRFRLYLASHPQYA

SEQ ID NO: 78523 - protein, 114 aa, Homo sapiens
  Payload ID: 15639
  Gene Symbol: SH2B1
  Gene Name: SH2B adaptor protein 1
  ENSP ID: ENSP00000457315
  MOD_RES (1)..(1): Any amino acid
XQSETRRGEYVLTFNFQGKAKHLRLSLNEEGQCRVQHLWFQSIFDMLEHFRVHPIPLESGGSSDVVLVSYVPSSQRQQGEQSRSAGEEVPVHPRSEVCVPERWGGEGGLSQGEA

SEQ ID NO: 78524 - protein, 200 aa, Homo sapiens
  Payload ID: 15639
  Gene Symbol: SH2B1
  Gene Name: SH2B adaptor protein 1
  ENSP ID: ENSP00000457724
  MOD_RES (1)..(1): Any amino acid
XWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGEQSRSAGEEVPVHPRSENRPPPMTHPSPLNPLHGQIPHSLGQKRRRGRQKWRQQQPQQPKRGKRKRKRAVEGSRKSWSPWLSWSPWLNWKRP

SEQ ID NO: 78525 - protein, 63 aa, Homo sapiens
  Payload ID: 15639
  Gene Symbol: SH2B1
  Gene Name: SH2B adaptor protein 1
  ENSP ID: ENSP00000458097
MNGAPSPEDGASPSSPPLPPPPPPSWREFCESHARAAALDFARRFRLYLASHPQYAGPGAEAA

SEQ ID NO: 78526 - protein, 756 aa, Homo sapiens; identical to SEQ ID NO: 78513
  Payload ID: 15639
  Gene Symbol: SH2B1
  Gene Name: SH2B adaptor protein 1
  Uniprot ID: Q9NRF2
  ENSP ID: ENSP00000481709

SEQ ID NO: 78527 - protein, 243 aa, Homo sapiens
  Payload ID: 15640
  Gene Symbol: SH2B2
  Gene Name: SH2B adaptor protein 2
  ENSP ID: ENSP00000401883
MNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPK

SEQ ID NO: 78528 - protein, 675 aa, Homo sapiens
  Payload ID: 15640
  Gene Symbol: SH2B2
  Gene Name: SH2B adaptor protein 2
  ENSP ID: ENSP00000440273
MDPSYCPAHGFPSQDPLWPLSSQQWSSAHYSEPAAGGCDGTEAMNGAGPGPAAAAPVPVPVPVPDWRQFCELHAQAAAVDFAHKFCRFLRDNPAYDTPDAGASFSRHFAANFLDVFGEEVRRVLVAGPTTRGAAVSAEAMEPELADTSALKAAPYGHSRSSEDVSTHAATKARVRKGFSLRNMSLCVVDGVRDMWHRRASPEPDAAAAPRTAEPRDKWTRRLRLSRTLAAKVELVDIQREGALRFMVADDAAAGSGGSAQWQKCRLLLRRAVAEERFRLEFFVPPKASRPKVSIPLSAIIEVRTTMPLEMPEKDNTFVLKVENGAEYILETIDSLQKHSWVADIQGCVDPGDSEEDTELSCTRGGCLASRVASCSCELLTDAVDLPRPPETTAVGAVVTAPHSRGRDAVRESLIHVPLETFLQTLESPGGSGSDSNNTGEQGAETDPEAEPELELSDYPWFHGTLSRVKAAQLVLAGGPRNHGLFVIRQSETRPGEYVLTFNFQGKAKHLRLSLNGHGQCHVQHLWFQSVLDMLRHFHTHPIPLESGGSADITLRSYVRAQDPPPEPGPTPPAAPASPACWSDSPGQHYFSSLAAAACPPASPSDAAGASSSSASSSSAASGPAPPRPVEGQLSARSRSNSAERLLEAVAATAAEEPPEAAPGRARAVENQYSFY

SEQ ID NO: 78529 - protein, 47 aa, Homo sapiens
  Payload ID: 15640
  Gene Symbol: SH2B2
  Gene Name: SH2B adaptor protein 2
  ENSP ID: ENSP00000483034
MDPSYCPAHGFPSQDPLWPLSSQQWSSAHYSEPGLQAQGQHPTVSHH

SEQ ID NO: 78530 - protein, 575 aa, Homo sapiens
  Payload ID: 15641
  Gene Symbol: SH2B3
  Gene Name: SH2B adaptor protein 3
  Uniprot ID: Q9UQQ2
  ENSP ID: ENSP00000345492
MNGPALQPSSPSSAPSASPAAAPRGWSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKSSRPKLQAACSSIQEVRWCTRLEMPDNLYTFVLKVKDRTDIIFEVGDEQQLNSWMAELSECTGRGLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 78531 - protein, 373 aa, Homo sapiens
  Payload ID: 15641
  Gene Symbol: SH2B3
  Gene Name: SH2B adaptor protein 3
  ENSP ID: ENSP00000440597
MGFPVLCRGWRRTWPGCASWLGAPPPQKPLLSPLLLNHRSSKSSRPKLQAACSSIQEVRWCTRLEMPDNLYTFVLKVKDRTDIIFEVGDEQQLNSWMAELSECTGRGLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 78532 - protein, 216 aa, Homo sapiens
  Payload ID: 15641
  Gene Symbol: SH2B3
  Gene Name: SH2B adaptor protein 3
  ENSP ID: ENSP00000473529
  MOD_RES (1)..(1): Any amino acid
XQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKWPEPELSRLRFRLKQGLSCAHVPTRCNLAGASGIGH

SEQ ID NO: 78533 - protein, 402 aa, Homo sapiens
  Payload ID: 15642
  Gene Symbol: STAC
  Gene Name: SH3 and cysteine rich domain
  Uniprot ID: Q99469
  ENSP ID: ENSP00000273183
MIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVGTNAKHGLRCKACKMSIHHKCTDGLAPQRCMGKLPKGFRRYYSSPLLIHEQFGCIKEVMPIACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 78534 - protein, 341 aa, Homo sapiens
  Payload ID: 15642
  Gene Symbol: STAC
  Gene Name: SH3 and cysteine rich domain
  ENSP ID: ENSP00000393713
MIPPSSPREDGVDGLPKEAVGAEQPPSPASTSSQESKLQKLKRSLSFKTKSLRSKSADNFFQRTNSEDMKLQAHMVAEISPSSSPLPAPGSLTSTPARAGLHPGGKAHAFQEYIFKKPTFCDVCNHMIVACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWKGKIQDRIGFFPANFVQRLQQNEKIFRCVRTFIGCKEQGQITLKENQICVSSEEEQDGFIRVLSGKKKGLIPLDVLENI

SEQ ID NO: 78535 - protein, 51 aa, Homo sapiens
  Payload ID: 15642
  Gene Symbol: STAC
  Gene Name: SH3 and cysteine rich domain
  ENSP ID: ENSP00000397521
MIPPSSPREDGVDGLPKEAVGAEQPPSPASTSSQESKEQMLSMDCAAKPVR

SEQ ID NO: 78536 - protein, 252 aa, Homo sapiens
  Payload ID: 15642
  Gene Symbol: STAC
  Gene Name: SH3 and cysteine rich domain
  ENSP ID: ENSP00000398403
MIPPSSPREDGVDGLPKEAVGAEQPPSPASTSSQESKTKSLRSKSADNFFQRTNSEDMKLQAHMVAEISPSSSPLPAPGSLTSTPARAGLHPGGKAHAFQEYIFKKPTFCDVCNHMIVACGNKVDPVYETLRFGTSLAQRTKKGSSGSGSDSPHRTSTSDLVEVPEEANGPGGGYDLRKRSNSVFTYPENGTDDFRDPAKNINHQGSLSKDPLQMNTYVALYKFVPQENEDLEMRPGDIITLLEDSNEDWWK

SEQ ID NO: 78537 - protein, 411 aa, Homo sapiens
  Payload ID: 15643
  Gene Symbol: STAC2
  Gene Name: SH3 and cysteine rich domain 2
  Uniprot ID: Q6ZMT1
  ENSP ID: ENSP00000327509
MTEMSEKENEPDDAATHSPPGTVSALQETKLQRFKRSLSLKTILRSKSLENFFLRSGSELKCPTEVLLTPPTPLPPPSPPPTASDRGLATPSPSPCPVPRPLAALKPVRLHSFQEHVFKRASPCELCHQLIVGNSKQGLRCKMCKVSVHLWCSEEISHQQCPGKTSTSFRRNFSSPLLVHEPPPVCATSKESPPTGDSGKVDPVYETLRYGTSLALMNRSSFSSTSESPTRSLSERDELTEDGEGSIRSSEEGPGDSASPVFTAPAESEGPGPEEKSPGQQLPKATLRKDVGPMYSYVALYKFLPQENNDLALQPGDRIMLVDDSNEDWWKGKIGDRVGFFPANFVQRVRPGENVWRCCQPFSGNKEQGYMSLKENQICVGVGRSKDADGFIRVSSGKKRGLVPVDALTEI

SEQ ID NO: 78538 - protein, 148 aa, Homo sapiens
  Payload ID: 15643
  Gene Symbol: STAC2
  Gene Name: SH3 and cysteine rich domain 2
  ENSP ID: ENSP00000463299
MTEMSEKENEPDDAATHSPPGTVSALQETKLQRFKRSLSLKTILRSKSLENFFLRSGSELKCPTEETPNRACDVRCAKSASTSGALRRSPTSNAQARRPPPSAATSVPLSWCMSRHQSVPQAKSPHPLGTVGRWTLSTRPCAMAPPWH

SEQ ID NO: 78539 - protein, 364 aa, Homo sapiens
  Payload ID: 15644
  Gene Symbol: STAC3
  Gene Name: SH3 and cysteine rich domain 3
  Uniprot ID: Q96MF2
  ENSP ID: ENSP00000329200
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 78540 - protein, 178 aa, Homo sapiens
  Payload ID: 15644
  Gene Symbol: STAC3
  Gene Name: SH3 and cysteine rich domain 3
  Uniprot ID: Q96MF2
  ENSP ID: ENSP00000441515
MANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 78541 - protein, 104 aa, Homo sapiens
  Payload ID: 15644
  Gene Symbol: STAC3
  Gene Name: SH3 and cysteine rich domain 3
  ENSP ID: ENSP00000450740
MANKERKKGQADKKNETLKGIRRLRRRHLMTSTSSLASSSLITLWLSIGSKPWRRTIWISRQERRSQSLMTPMKNGGGGKSGRRSDFSLQTSSFGSGLENVCTA

SEQ ID NO: 78542 - protein, 325 aa, Homo sapiens
  Payload ID: 15644
  Gene Symbol: STAC3
  Gene Name: SH3 and cysteine rich domain 3
  Uniprot ID: Q96MF2
  ENSP ID: ENSP00000452068
MELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 78543 - protein, 168 aa, Homo sapiens
  Payload ID: 15644
  Gene Symbol: STAC3
  Gene Name: SH3 and cysteine rich domain 3
  ENSP ID: ENSP00000452299
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDL

SEQ ID NO: 78544 - protein, 2161 aa, Homo sapiens
  Payload ID: 15645
  Gene Symbol: SHANK1
  Gene Name: SH3 and multiple ankyrin repeat domains 1
  Uniprot ID: Q9Y566
  ENSP ID: ENSP00000293441
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSLMDGIGPGSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 78545 - protein, 2152 aa, Homo sapiens
  Payload ID: 15645
  Gene Symbol: SHANK1
  Gene Name: SH3 and multiple ankyrin repeat domains 1
  Uniprot ID: Q9Y566
  ENSP ID: ENSP00000351984
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 78546 - protein, 1548 aa, Homo sapiens
  Payload ID: 15645
  Gene Symbol: SHANK1
  Gene Name: SH3 and multiple ankyrin repeat domains 1
  Uniprot ID: Q9Y566
  ENSP ID: ENSP00000375689
MQLMALEQRFGSGLPGGGQPLCLMMSSPLPPPPPHFSCLPASDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 78547 - protein, 2169 aa, Homo sapiens
  Payload ID: 15645
  Gene Symbol: SHANK1
  Gene Name: SH3 and multiple ankyrin repeat domains 1
  ENSP ID: ENSP00000375690
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSLMDGIGPGSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMVSPWKKKSEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 78548 - protein, 183 aa, Homo sapiens
  Payload ID: 15645
  Gene Symbol: SHANK1
  Gene Name: SH3 and multiple ankyrin repeat domains 1
  ENSP ID: ENSP00000469719
PGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQSIE

SEQ ID NO: 78549 - protein, 1261 aa, Homo sapiens
  Payload ID: 15646
  Gene Symbol: SHANK2
  Gene Name: SH3 and multiple ankyrin repeat domains 2
  ENSP ID: ENSP00000345193
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 78550 - protein, 244 aa, Homo sapiens [sequence omitted]

SEQ ID NO: 78551 - protein, 1253 aa, Homo sapiens
  Payload ID: 15646
  Gene Symbol: SHANK2
  Gene Name: SH3 and multiple ankyrin repeat domains 2
  ENSP ID: ENSP00000386491
MMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 78552 - protein, 281 aa, Homo sapiens
  Payload ID: 15646
  Gene Symbol: SHANK2
  Gene Name: SH3 and multiple ankyrin repeat domains 2
  Uniprot ID: Q9UPX8
  ENSP ID: ENSP00000387324
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIGKKCGTPPQKLPLGFQTQP

SEQ ID NO: 78553 - protein, 212 aa, Homo sapiens
  Payload ID: 15646
  Gene Symbol: SHANK2
  Gene Name: SH3 and multiple ankyrin repeat domains 2
  ENSP ID: ENSP00000390636
  MOD_RES (1)..(1): Any amino acid
XTPLTLAAQLDDSVEVIKALKNGGAHLDFRAKDGMTALHKAARARNQVALKTLLELGASPDYKDSYGLTPLYHTAIVGGDPYCCELLLHEHATVCCKDENGWHEIHQACRYGHVQHLEHLLFYGADMSAQNASGNTALHICALYNQDSCARVLLFRGGNKELKNYNSQTPFQPQKAATRDHRWVSVPTLLLLRPPRTHEARAALPSASPRVL

SEQ ID NO: 78554 - protein, 153 aa, Homo sapiens
  Payload ID: 15646
  Gene Symbol: SHANK2
  Gene Name: SH3 and multiple ankyrin repeat domains 2
  ENSP ID: ENSP00000391570
  MOD_RES (1)..(1): Any amino acid
XTETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKDKPEEIVPASK

SEQ ID NO: 78555 - protein, 186 aa, Homo sapiens
  Payload ID: 15646
  Gene Symbol: SHANK2
  Gene Name: SH3 and multiple ankyrin repeat domains 2
  ENSP ID: ENSP00000392674
  MOD_RES (1)..(1): Any amino acid
XFYKLQGPSCRFHLPEGRHPGGRGTRMDVGTTSALPFSQCPSERPRRTPTAGGGPPTRWPPPGSCCAPTVTTTSMPALPTGPSAPRPPRTAACHPSCCSRCPASPRGPRRPLGATCPGPAAGPHRSTGWAAQARTARGRSLSGMSGRLLLLVPTRTHSRPSSTRGPSGSSTVPCPGGSSSLSSHTN

SEQ ID NO: 78556 - protein, 1470 aa, Homo sapiens
  Payload ID: 15646
  Gene Symbol: SHANK2
  Gene Name: SH3 and multiple ankyrin repeat domains 2
  Uniprot ID: Q9UPX8
  ENSP ID: ENSP00000394536
MKSLLNAFTKKEVPFREAPAYSNRRRRPPNTLAAPRVLLRSNSDNNLNASAPDWAVCSTATSHRSLSPQLLQQMPSKPEGAAKTIGSYVPGPRSRSPSLNRLGGAGEDGKRPQPLWHVGSPFALGANKDSLSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 78557 - protein, 271 aa, Homo sapiens
  Payload ID: 15646
  Gene Symbol: SHANK2
  Gene Name: SH3 and multiple ankyrin repeat domains 2
  ENSP ID: ENSP00000394939
MMMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELDKPEEIVPASKPSRAAENMAVEPRVATIKQRPSSRCFPAGSDMNSVYERQGIAVMTPTVPGSPKAPFLGIPRGTMRRQKSIGKKCGTPPQKLPLGFQTQP

SEQ ID NO: 78558 - protein, 1261 aa, Homo sapiens [sequence omitted]

SEQ ID NO: 78559 - protein, 1128 aa, Homo sapiens
  Payload ID: 15646
  Gene Symbol: SHANK2
  Gene Name: SH3 and multiple ankyrin repeat domains 2
  ENSP ID: ENSP00000402944
LVLKVVTVTRNLDPDDTARKKAPPPPKRAPTTALTLRSKSMTSELEELDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 78560 - protein, 257 aa, Homo sapiens
  Payload ID: 15646
  Gene Symbol: SHANK2
  Gene Name: SH3 and multiple ankyrin repeat domains 2
  ENSP ID: ENSP00000414876
  MOD_RES (1)..(1): Any amino acid
XMNVPGGGAAAVMMTGYNNGRCPRNSLYSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPREARRS

SEQ ID NO: 78561 - protein, 1849 aa, Homo sapiens
  Payload ID: 15646
  Gene Symbol: SHANK2
  Gene Name: SH3 and multiple ankyrin repeat domains 2
  Uniprot ID: Q9UPX8
  ENSP ID: ENSP00000469689
MPRSPTSSEDEMAQSFSDYSVGSESDSSKEETIYDTIRATAEKPGGARTEESQGNTLVIRVVIHDLQQTKCIRFNPDATVWVAKQRILCTLTQSLKDVLNYGLFQPASNGRDGKFLDEERLLREYPQPVGEGVPSLEFRYKKRVYKQASLDEKQLAKLHTKTNLKKCMDHIQHRLVEKITKMLDRGLDPNFHDPETGETPLTLAAQLDDSVEVIKALKNGGAHLDFRAKDGMTALHKAARARNQVALKTLLELGASPDYKDSYGLTPLYHTAIVGGDPYCCELLLHEHATVCCKDENGWHEIHQACRYGHVQHLEHLLFYGADMSAQNASGNTALHICALYNQDSCARVLLFRGGNKELKNYNSQTPFQVAIIAGNFELAEYIKNHKETDIVPFREAPAYSNRRRRPPNTLAAPRVLLRSNSDNNLNASAPDWAVCSTATSHRSLSPQLLQQMPSKPEGAAKTIGSYVPGPRSRSPSLNRLGGAGEDGKRPQPLWHVGSPFALGANKDSLSAFEYPGPKRKLYSAVPGRLFVAVKPYQPQVDGEIPLHRGDRVKVLSIGEGGFWEGSARGHIGWFPAECVEEVQCKPRDSQAETRADRSKKLFRHYTVGSYDSFDTSSDCIIEEKTVVLQKKDNEGFGFVLRGAKADTPIEEFTPTPAFPALQYLESVDEGGVAWQAGLRTGDFLIEVNNENVVKVGHRQVVNMIRQGGNHLVLKVVTVTRNLDPDDTARKKAPPPPKRAPTTALTLRSKSMTSELEELVDKASVRKKKDKPEEIVPASKPSRAAENMAVEPRVATIKQRPSSRCFPAGSDMNSVYERQGIAVMTPTVPGSPKAPFLGIPRGTMRRQKSIDSRIFLSGITEEERQFLAPPMLKFTRSLSMPDTSEDIPPPPQSVPPSPPPPSPTTYNCPKSPTPRVYGTIKPAFNQNSAAKVSPATRSDTVATMMREKGMYFRRELDRYSLDSEDLYSRNAGPQANFRNKRGQMPENPYSEVGKIASKAVYVPAKPARRKGMLVKQSNVEDSPEKTCSIPIPTIIVKEPSTSSSGKSSQGSSMEIDPQAPEPPSQLRPDESLTVSSPFAAAIAGAVRDREKRLEARRNSPAFLSTDLGDEDVGLGPPAPRTRPSMFPEEGDFADEDSAEQLSSPMPSATPREPENHFVGGAEASAPGEAGRPLNSTSKAQGPESSPAVPSASSGTAGPGNYVHPLTGRLLDPSSPLALALSARDRAMKESQQGPKGEAPKADLNKPLYIDTKMRPSLDAGFPTVTRQNTRGPLRRQETENKYETDLGRDRKGDDKKNMLIDIMDTSQQKSAGLLMVHTVDATKLDNALQEEDEKAEVEMKPDSSPSEVPEGVSETEGALQISAAPEPTTVPGRTIVAVGSMEEAVILPFRIPPPPLASVDLDEDFIFTEPLPPPLEFANSFDIPDDRAASVPALSDLVKQKKSDTPQSPSLNSSQPTNSADSKKPASLSNCLPASFLPPPESFDAVADSGIEEVDSRSSSDHHLETTSTISTVSSISTLSSEGGENVDTCTVYADGQAFMVDKPPVPPKPKMKPIIHKSNALYQDALVEEDVDSFVIPPPAPPPPPGSAQPGMAKVLQPRTSKLWGDVTEIKSPILSGPKANVISELNSILQQMNREKLAKPGEGLDSPMGAKSASLAPRSPEIMSTISGTRSTTVTFTVRPGTSQPITLQSRPPDYESRTSGTRRAPSPVVSPTEMNKETLPAPLSAATASPSPALSDVFSLPSQPPSGDLFGLNPAGRSRSPSPSILQQPISNKPFTTKPVHLWTKPDVADWLESLNLGEHKEAFMDNEIDGSHLPNLQKEDLIDLGVTRVGHRMNIERALKQLLDR

SEQ ID NO: 78562 - protein, 126 aa, Homo sapiens
  Payload ID: 15646
  Gene Symbol: SHANK2
  Gene Name: SH3 and multiple ankyrin repeat domains 2
  ENSP ID: ENSP00000476264
MPRSPTSSEDEMAQSFSDYSVGSESDSSKEETIYDTIRATAEKPGGARTEESQGNTLVIRVVIHDLQQTKCIRFNPDATVWVAKQRILCTLTQSLKDVLNYGLFQPASNGRDGRSFPGVSIQEAGV

SEQ ID NO: 78563 - protein, 108 aa, Homo sapiens
  Payload ID: 15646
  Gene Symbol: SHANK2
  Gene Name: SH3 and multiple ankyrin repeat domains 2
  ENSP ID: ENSP00000482553
  MOD_RES (1)..(1): Any amino acid
XEHATVCCKDENGWHEIHQACRYGHVQHLEHLLFYGADMSAQNASGNTALHICALYNQDSCARVLLFRGGNKELKNYNSQTPFQVAIIAGNFELAEYIKNHKETDIGE

SEQ ID NO: 78564 - protein, 74 aa, Homo sapiens
  Payload ID: 15646
  Gene Symbol: SHANK2
  Gene Name: SH3 and multiple ankyrin repeat domains 2
  ENSP ID: ENSP00000483920
  MOD_RES (1)..(1): Any amino acid
XAGFESSPSTCSWFPADRQNMGWALSPARWVWHAQLCSEVHRAQTPATSPRVPAALAPRGRAARLSFLPSRKVI

SEQ ID NO: 78565 - protein, 1730 aa, Homo sapiens
  Payload ID: 15647
  Gene Symbol: SHANK3
  Gene Name: SH3 and multiple ankyrin repeat domains 3
  ENSP ID: ENSP00000489147
MDGPGASAVVVRVGIPDLQQTKCLRLDPAAPVWAAKQRVLCALNHSLQDALNYGLFQPPSRGRAGKFLDEERLLQEYPPNLDTPLPYLEFRYKRRVYAQNLIDDKQFAKLHTKANLKKFMDYVQLHSTDKVARLLDKGLDPNFHDPDSGECPLSLAAQLDNATDLLKVLKNGGAHLDFRTRDGLTAVHCATRQRNAAALTTLLDLGASPDYKDSRGLTPLYHSALGGGDALCCELLLHDHAQLGITDENGWQEIHQACRFGHVQHLEHLLFYGADMGAQNASGNTALHICALYNQESCARVLLFRGANRDVRNYNSQTAFQVAIIAGNFELAEVIKTHKDSDVVPFRETPSYAKRRRLAGPSGLASPRPLQRSASDINLKGEAQPAASPGPSLRSLPHQLLLQRLQEEKDRDRDADQESNISGPLAGRAGQSKISPAGPGDPGPGPGGPAPPAPPAPPPRGPKRKLYSAVPGRKFIAVKAHSPQGEGEIPLHRGEAVKVLSIGEGGFWEGTVKGRTGWFPADCVEEVQMRQHDTRPETREDRTKRLFRHYTVGSYDSLTSHSDYVIDDKVAVLQKRDHEGFGFVLRGAKAETPIEEFTPTPAFPALQYLESVDVEGVAWRAGLRTGDFLIEVNGVNVVKVGHKQVVALIRQGGNRLVMKVVSVTRKPEEDGARRRAPPPPKRAPSTTLTLRSKSMTAELEELASIRRRKGEKLDEMLAAAAEPTLRPDIADADSRAATVKQRPTSRRITPAEISSLFERQGLPGPEKLPGSLRKGIPRTKSVGEDEKLASLLEGRFPRSTSMQDPVREGRGIPPPPQTAPPPPPAPYYFDSGPPPAFSPPPPPGRAYDTVRSSFKPGLEARLGAGAAGLYEPGAALGPLPYPERQKRARSMIILQDSAPESGDAPRPPPAATPPERPKRRPRPPGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 78566 - protein, 1724 aa, Homo sapiens
  Payload ID: 15647
  Gene Symbol: SHANK3
  Gene Name: SH3 and multiple ankyrin repeat domains 3
  ENSP ID: ENSP00000489407
MDGPGASAVVVRVGIPDLQQTKCLRLDPAAPVWAAKQRVLCALNHSLQDALNYGLFQPPSRGRAGKFLDEERLLQEYPPNLDTPLPYLEFRYKRRVYAQNLIDDKQFAKLHTKANLKKFMDYVQLHSTDKVARLLDKGLDPNFHDPDSGECPLSLAAQLDNATDLLKVLKNGGAHLDFRTRDGLTAVHCATRQRNAAALTTLLDLGASPDYKDSRGLTPLYHSALGGGDALCCELLLHDHAQLGITDENGWQEIHQACRFGHVQHLEHLLFYGADMGAQNASGNTALHICALYNQESCARVLLFRGANRDVRNYNSQTAFQVAIIAGNFELAEVIKTHKDSDVVPFRETPSYAKRRRLAGPSGLASPRPLQRSASDINLKGEAQPAASPGPSLRSLPHQLLLQRLQEEKDRDRDADQESNISGPLAGRAGQSKIREGAGRPCPAPPAPPAPPPRGPKRKLYSAVPGRKFIAVKAHSPQGEGEIPLHRGEAVKVLSIGEGGFWEGTVKGRTGWFPADCVEEVQMRQHDTRPETREDRTKRLFRHYTVGSYDSLTSHSDYVIDDKVAVLQKRDHEGFGFVLRGAKAETPIEEFTPTPAFPALQYLESVDVEGVAWRAGLRTGDFLIEVNGVNVVKVGHKQVVALIRQGGNRLVMKVVSVTRKPEEDGARRRAPPPPKRAPSTTLTLRSKSMTAELEELASIRRRKGEKLDEMLAAAAEPTLRPDIADADSRAATVKQRPTSRRITPAEISSLFERQGLPGPEKLPGSLRKGIPRTKSVGEDEKLASLLEGRFPRSTSMQDPVREGRGIPPPPQTAPPPPPAPYYFDSGPPPAFSPPPPPGRAYDTVRSSFKPGLEARLGAGAAGLYEPGAALGPLPYPERQKRARSMIILQDSAPESGDAPRPPPAATPPERPKRRPRPPGPDSPYANLGAFSASLFAPSKPQRRKSPLVKQLQVEDAQERAALAVGSPGPGGGSFAREPSPTHRGPRPGGLDYGAGDGPGLAFGGPGPAKDRRLEERRRSTVFLSVGAIEGSAPGADLPSLQPSRSIDERLLGTGPTAGRDLLLPSPVSALKPLVSGPSLGPSGSTFIHPLTGKPLDPSSPLALALAARERALASQAPSRSPTPVHSPDADRPGPLFVDVQARDPERGSLASPAFSPRSPAWIPVPARREAEKVPREERKSPEDKKSMILSVLDTSLQRPAGLIVVHATSNGQEPSRLGGAEEERPGTPELAPAPMQSAAVAEPLPSPRAQPPGGTPADAGPGQGSSEEEPELVFAVNLPPAQLSSSDEETREELARIGLVPPPEEFANGVLLATPLAGPGPSPTTVPSPASGKPSSEPPPAPESAADSGVEEADTRSSSDPHLETTSTISTVSSMSTLSSESGELTDTHTSFADGHTFLLEKPPVPPKPKLKSPLGKGPVTFRDPLLKQSSDSELMAQQHHAASAGLASAAGPARPRYLFQRRSKLWGDPVESRGLPGPEDDKPTVISELSSRLQQLNKDTRSLGEEPVGGLGSLLDPAKKSPIAAARLFSSLGELSSISAQRSPGGPGGGASYSVRPSGRYPVARRAPSPVKPASLERVEGLGAGAGGAGRPFGLTPPTILKSSSLSIPHEPKEVRFVVRSVSARSRSPSPSPLPSPASGPGPGAPGPRRPFQQKPLQLWSKFDVGDWLESIHLGEHRDRFEDHEIEGAHLPALTKDDFVELGVTRVGHRMNIERALRQLDGS

SEQ ID NO: 78567 - protein, 1105 aa, Homo sapiens
  Payload ID: 15648
  Gene Symbol: SH3PXD2A
  Gene Name: SH3 and PX domains 2A
  Uniprot ID: Q5TCZ1
  ENSP ID: ENSP00000348215
MLAYCVQDATVVDVEKRRNPSKHYVYIINVTWSDSTSQTIYRRYSKFFDLQMQLLDKFPIEGGQKDPKQRIIPFLPGKILFRRSHIRDVAVKRLKPIDEYCRALVRLPPHISQCDEVFRFFEARPEDVNPPKEDYGSSKRKSVWLSSWAESPKKDVTGADATAEPMILEQYVVVSNYKKQENSELSLQAGEVVDVIEKNESGWWFVSTSEEQGWVPATYLEAQNGTRDDSDINTSKTGEEEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 78568 - protein, 1133 aa, Homo sapiens
  Payload ID: 15648
  Gene Symbol: SH3PXD2A
  Gene Name: SH3 and PX domains 2A
  Uniprot ID: Q5TCZ1
  ENSP ID: ENSP00000358789
MLAYCVQDATVVDVEKRRNPSKHYVYIINVTWSDSTSQTIYRRYSKFFDLQMQLLDKFPIEGGQKDPKQRIIPFLPGKILFRRSHIRDVAVKRLKPIDEYCRALVRLPPHISQCDEVFRFFEARPEDVNPPKEDYGSSKRKSVWLSSWAESPKKDVTGADATAEPMILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 78569 - protein, 1060 aa, Homo sapiens
  Payload ID: 15648
  Gene Symbol: SH3PXD2A
  Gene Name: SH3 and PX domains 2A
  ENSP ID: ENSP00000395781
  MOD_RES (1)..(1): Any amino acid
XFFDLQMQLLDKFPIEGGQKDPKQRIIPFLPGKILFRRSHIRDVAVKRLKPIDEYCRALVRLPPHISQCDEVFRFFEARPEDVNPPKEDYGSSKRKSVWLSSWAESPKKDVTGADATAEPMILEQYVVVSNYKKQENSELSLQAGEVVDVIEKNESGWWFVSTSEEQGWVPATYLEAQNGTRDDSDINTSKTGEEEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 78570 - protein, 911 aa, Homo sapiens
  Payload ID: 15649
  Gene Symbol: SH3PXD2B
  Gene Name: SH3 and PX domains 2B
  Uniprot ID: A1X283
  ENSP ID: ENSP00000309714
MPPRRSIVEVKVLDVQKRRVPNKHYVYIIRVTWSSGSTEAIYRRYSKFFDLQMQMLDKFPMEGGQKDPKQRIIPFLPGKILFRRSHIRDVAVKRLIPIDEYCKALIQLPPYISQCDEVLQFFETRPEDLNPPKEEHIGKKKSGGDQTSVDPMVLEQYVVVANYQKQESSEISLSVGQVVDIIEKNESGWWFVSTAEEQGWVPATCLEGQDGVQDEFSLQPEEEEKYTVIYPYTARDQDEMNLERGAVVEVIQKNLEGWWKIRYQGKEGWAPASYLKKNSGEPLPPKPGPGSPSHPGALDLDGVSRQQNAVGREKELLSSQRDGRFEGRPVPDGDAKQRSPKMRQRPPPRRDMTIPRGLNLPKPPIPPQVEEEYYTIAEFQTTIPDGISFQAGLKVEVIEKNLSGWWYIQIEDKEGWAPATFIDKYKKTSNASRPNFLAPLPHEVTQLRLGEAAALENNTGSEATGPSRPLPDAPHGVMDSGLPWSKDWKGSKDVLRKASSDMSASAGYEEISDPDMEEKPSLPPRKESIIKSEGELLERERERQRTEQLRGPTPKPPGVILPMMPAKHIPPARDSRRPEPKPDKSRLFQLKNDMGLECGHKVLAKEVKKPNLRPISKSKTDLPEEKPDATPQNPFLKSRPQVRPKPAPSPKTEPPQGEDQVDICNLRSKLRPAKSQDKSLLDGEGPQAVGGQDVAFSRSFLPGEGPGRAQDRTGKQDGLSPKEISCRAPPRPAKTTDPVSKSVPVPLQEAPQQRPVVPPRRPPPPKKTSSSSRPLPEVRGPQCEGHESRAAPTPGRALLVPPKAKPFLSNSLGGQDDTRGKGSLGPWGTGKIGENREKAAAASVPNADGLKDSLYVAVADFEGDKDTSSFQEGTVFEVREKNSSGWWFCQVLSGAPSWEGWIPSNYLRKKP

SEQ ID NO: 78571 - protein, 81 aa, Homo sapiens
  Payload ID: 15649
  Gene Symbol: SH3PXD2B
  Gene Name: SH3 and PX domains 2B
  ENSP ID: ENSP00000428076
  MOD_RES (1)..(1): Any amino acid
XPDGDAKQRSPKMRQRPPPRRDMTIPRGLNLPKPPIPPQVEEEYYTIAEFQTTIPDGISFQAGLKVEEQWALPTTSCLLIG

SEQ ID NO: 78572 - protein, 430 aa, Homo sapiens
  Payload ID: 15649
  Gene Symbol: SH3PXD2B
  Gene Name: SH3 and PX domains 2B
  ENSP ID: ENSP00000430890
MPPRRSIVEVKVLDVQKRRVPNKHYVYIIRVTWSSGSTEAIYRRYSKFFDLQMQMLDKFPMEGGQKDPKQRIIPFLPGKILFRRSHIRDVAVKRLIPIDEYCKALIQLPPYISQCDEVLQFFETRPEDLNPPKEEHIGKKKSGGDQTSVDPMVLEQYVVVANYQKQESSEISLSVGQVVDIIEKNESGWWFVSTAEEQGWVPATCLEGQDGVQDEFSLQPEEEEKYTVIYPYTARDQDEMNLERGAVVEVIQKNLEGWWKIRYQGKEGWAPASYLKKNSGEPLPPKPGPGSPSHPGALDLDGVSRQQNAVGREKELLSSQRDGRFEGRPVPDGDAKQRSPKMRQRPPPRRDMTIPRGLNLPKPPIPPQVEEEYYTIAEFQTTIPDGISFQAGLKVEDHKNVHLESPVEVPLRRIKMRTALGKHVAASMEM

SEQ ID NO: 78573 - protein, 342 aa, Homo sapiens
  Payload ID: 15650
  Gene Symbol: SH3YL1
  Gene Name: SH3 and SYLF domain containing 1
  Uniprot ID: Q96HL8
  ENSP ID: ENSP00000348471
MNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNRNEYKLYPGLSSYHERVGNLNQPIEVTALYSFEGQQPGDLNFQAGDRITVISKTDSHFDWWEGKLRGQTGIFPANYVTMN

SEQ ID NO: 78574 - protein, 227 aa, Homo sapiens
  Payload ID: 15650
  Gene Symbol: SH3YL1
  Gene Name: SH3 and SYLF domain containing 1
  Uniprot ID: Q96HL8
  ENSP ID: ENSP00000383928
MVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNLNQPIEVTALYSFEGQQPGDLNFQAGDRITVISKTDSHFDWWEGKLRGQTGIFPANYVTMN

SEQ ID NO: 78575 - protein, 342 aa, Homo sapiens; identical to SEQ ID NO: 78573
  Payload ID: 15650
  Gene Symbol: SH3YL1
  Gene Name: SH3 and SYLF domain containing 1
  Uniprot ID: Q96HL8
  ENSP ID: ENSP00000384269

SEQ ID NO: 78576 - protein, 323 aa, Homo sapiens
  Payload ID: 15650
  Gene Symbol: SH3YL1
  Gene Name: SH3 and SYLF domain containing 1
  Uniprot ID: Q96HL8
  ENSP ID: ENSP00000384276
MNNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNLNQPIEVTALYSFEGQQPGDLNFQAGDRITVISKTDSHFDWWEGKLRGQTGIFPANYVTMN

SEQ ID NO: 78577 - protein, 114 aa, Homo sapiens
  Payload ID: 15650
  Gene Symbol: SH3YL1
  Gene Name: SH3 and SYLF domain containing 1
  Uniprot ID: Q96HL8
  ENSP ID: ENSP00000384910
MNNPIPSNLKSEAKKAAKILREFTEITSRNGPDKIIPAHVIAKAKGLAILSVIKAGFLVTARGGSGIVVARLPDGKWSAPSAIGIAGLGGGFEIGIETHLQLHIPSEHCPGCLP

SEQ ID NO: 78578 - protein, 227 aa, Homo sapiens; identical to SEQ ID NO: 78574
  Payload ID: 15650
  Gene Symbol: SH3YL1
  Gene Name: SH3 and SYLF domain containing 1
  Uniprot ID: Q96HL8
  ENSP ID: ENSP00000385668

SEQ ID NO: 78579 - protein, 230 aa, Homo sapiens
  Payload ID: 15650
  Gene Symbol: SH3YL1
  Gene Name: SH3 and SYLF domain containing 1
  ENSP ID: ENSP00000399519
NNPIPSNLKSEAKKAAKILREFTEITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRFYCQDIRAYDILFGDTPRPAQAEDLYEILDSFTEKYENEGQRINARKAAREQRKSSAKELPPKPLSRPQQSSAPVQLNSGSQSKYFCCNSNTVVIK

SEQ ID NO: 78580 - protein, 50 aa, Homo sapiens
  Payload ID: 15650
  Gene Symbol: SH3YL1
  Gene Name: SH3 and SYLF domain containing 1
  ENSP ID: ENSP00000410235
MNNPIPSNLKSEAKKAAKILREFTEITSRNGPDKIIPAHVIAKAKGLAIL

SEQ ID NO: 78581 - protein, 59 aa, Homo sapiens
  Payload ID: 15650
  Gene Symbol: SH3YL1
  Gene Name: SH3 and SYLF domain containing 1
  ENSP ID: ENSP00000415723
MVSDLVIILNYDRAVEAFAKGGNLTLGGNLTVAVGPLGRNLEGNVALRSSAAVFTYCKS

SEQ ID NO: 78582 - protein, 255 aa, Homo sapiens
  Payload ID: 15650
  Gene Symbol: SH3YL1
  Gene Name: SH3 and SYLF domain containing 1
  ENSP ID: ENSP00000416312
ITSRNGPDKIIPAHVIAKAKGLAILSVIKAGFLVTARGGSGIVVARLPDGKWSAPSAIGIAGLGGGFEIGIEVSDLVIILNYDRAVEAFAKGGNLTLGGNLTVAVGPLGRFYCQDIRAYDILFGDTPRPAQAEDLYEILDSFTEKYENEGQRINARKAAREQRKSSAKELPPKPLSRPQQSSAPVQLNSGSQSNLNQPIEVTALYSFEGQQPGDLNFQAGDRITVISKTDSHFDWWEGKLRGQTGIFPANYVTMN

SEQ ID NO: 78583 - protein, 155 aa, Homo sapiens
  Payload ID: 15650
  Gene Symbol: SH3YL1
  Gene Name: SH3 and SYLF domain containing 1
  ENSP ID: ENSP00000441266
MVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSVPFGFMFHSVFSENLFL

SEQ ID NO: 78584 - protein, 98 aa, Homo sapiens
  Payload ID: 15650
  Gene Symbol: SH3YL1
  Gene Name: SH3 and SYLF domain containing 1
  ENSP ID: ENSP00000474411
  MOD_RES (1)..(1): Any amino acid
XEAFAKGGNLTLGGNLTVAVGPLGRFYCQDIRAYDILFGDTPRPAQAEDLYEILDSFTEKYENEGQRINARKAAREQRKSSVPFGFMFHSVFSENLFL

SEQ ID NO: 78585 - protein, 246 aa, Homo sapiens
  Payload ID: 15650
  Gene Symbol: SH3YL1
  Gene Name: SH3 and SYLF domain containing 1
  Uniprot ID: Q96HL8
  ENSP ID: ENSP00000485824
MVSDLVIILNYDRAVEAFAKGGNLTLGGNLTVAVGPLGRNLEGNVALRSSAAVFTYCKSRGLFAGVSLEGSCLIERKETNRKFYCQDIRAYDILFGDTPRPAQAEDLYEILDSFTEKYENEGQRINARKAAREQRKSSAKELPPKPLSRPQQSSAPVQLNSGSQSNRNEYKLYPGLSSYHERVGNLNQPIEVTALYSFEGQQPGDLNFQAGDRITVISKTDSHFDWWEGKLRGQTGIFPANYVTMN

SEQ ID NO: 78586 - protein, 1336 aa, Homo sapiens
  Payload ID: 15651
  Gene Symbol: SH3TC1
  Gene Name: SH3 domain and tetratricopeptide repeats 1
  Uniprot ID: Q8TE82
  ENSP ID: ENSP00000245105
MENLPAVTTEEPTPMGRGPVGPSGGGSTRDQVRTVVMRPSVSWEKAGPEEAKAPVRGDEAPPARVAGPAAGTPPCQMGVYPTDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSLEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALRGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 78587 - protein, 113 aa, Homo sapiens
  Payload ID: 15651
  Gene Symbol: SH3TC1
  Gene Name: SH3 domain and tetratricopeptide repeats 1
  ENSP ID: ENSP00000371961
MENLPAVTTEEPTPMGRGPVGPSGGGSTRDQVRTVVMRPSVSWEKAGPEEAKAPVRGGATVPAESLERPGPSSCFSRDASVITKLAKNEAGAFEPPCSETVPETVRWVWPWNP

SEQ ID NO: 78588 - protein, 94 aa, Homo sapiens
  Payload ID: 15651
  Gene Symbol: SH3TC1
  Gene Name: SH3 domain and tetratricopeptide repeats 1
  ENSP ID: ENSP00000390311
MENLPAVTTEEPTPMGRGPVGPSGGGSTRDQVRTVVMRPSVSWEKAGPEEAKAPVRGDEAPPARVAGPAAGTPPCQMGVYPTDLTLQLLAVRRK

SEQ ID NO: 78589 - protein, 105 aa, Homo sapiens
  Payload ID: 15651
  Gene Symbol: SH3TC1
  Gene Name: SH3 domain and tetratricopeptide repeats 1
  ENSP ID: ENSP00000422315
MGVYPTDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLP

SEQ ID NO: 78590 - protein, 101 aa, Homo sapiens
  Payload ID: 15651
  Gene Symbol: SH3TC1
  Gene Name: SH3 domain and tetratricopeptide repeats 1
  ENSP ID: ENSP00000423583
  MOD_RES (1)..(1): Any amino acid
XHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAQ

SEQ ID NO: 78591 - protein, 76 aa, Homo sapiens
  Payload ID: 15651
  Gene Symbol: SH3TC1
  Gene Name: SH3 domain and tetratricopeptide repeats 1
  ENSP ID: ENSP00000425079
MENLPAVTTEEPTPMGRGPVGPSGGGSTRDQVRTVVMRPSVSWEKAGPEEAKAPVRGERPGAFGAFRGARPLLGLP

SEQ ID NO: 78592 - protein, 202 aa, Homo sapiens
  Payload ID: 15651
  Gene Symbol: SH3TC1
  Gene Name: SH3 domain and tetratricopeptide repeats 1
  ENSP ID: ENSP00000425970
MENLPAVTTEEPTPMGRGPVGPSGGGSTRDQVRTVVMRPSVSWEKAGPEEAKAPVRGDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLPSEEEETAIQVHVDENALRLTHESLLIQEGGLLGSPRTPSTMPWVAL

SEQ ID NO: 78593 - protein, 183 aa, Homo sapiens
  Payload ID: 15651
  Gene Symbol: SH3TC1
  Gene Name: SH3 domain and tetratricopeptide repeats 1
  ENSP ID: ENSP00000426035
HVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWLESAIFLNEEEKSFFSEGCFSEEDARQLLR

SEQ ID NO: 78594 - protein, 25 aa, Homo sapiens
  Payload ID: 15651
  Gene Symbol: SH3TC1
  Gene Name: SH3 domain and tetratricopeptide repeats 1
  ENSP ID: ENSP00000427316
  MOD_RES (1)..(1): Any amino acid
XTYHALELEGSCRPVASVLTGKAVI

SEQ ID NO: 78595 - protein, 41 aa, Homo sapiens
  Payload ID: 15651
  Gene Symbol: SH3TC1
  Gene Name: SH3 domain and tetratricopeptide repeats 1
  ENSP ID: ENSP00000475411
  MOD_RES (1)..(1): Any amino acid
XYQKARTFATELNVRRVNLPPLPLCGPLCAEVGAASAPIRQ

SEQ ID NO: 78596 - protein, 227 aa, Homo sapiens
  Payload ID: 15652
  Gene Symbol: SH3TC2
  Gene Name: SH3 domain and tetratricopeptide repeats 2
  ENSP ID: ENSP00000313025
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLGYVSMCLEHLLFDHKYWLNCILVEDTEIQVSVDDKHLETIYLGLLIQEGHFFCRALCSVTPPAEKEGECLTLCKNELISVKMAEAGSELEGVSLVTGGS

SEQ ID NO: 78597 - protein, 150 aa, Homo sapiens
  Payload ID: 15652
  Gene Symbol: SH3TC2
  Gene Name: SH3 domain and tetratricopeptide repeats 2
  Uniprot ID: Q8TF17
  ENSP ID: ENSP00000421092
MSEQMMQSVGCRISLSVFQFLGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 78598 - protein, 95 aa, Homo sapiens
  Payload ID: 15652
  Gene Symbol: SH3TC2
  Gene Name: SH3 domain and tetratricopeptide repeats 2
  ENSP ID: ENSP00000421420
MGGCFCIPRERSLTRGPGKETPSKDPTVSSECIASSEYKEKCFLPQNINPDLTLSFCVKSRSRRCVNGPLQEAARRRLWALENEDQEVRMLFKVL

SEQ ID NO: 78599 - protein, 141 aa, Homo sapiens
  Payload ID: 15652
  Gene Symbol: SH3TC2
  Gene Name: SH3 domain and tetratricopeptide repeats 2
  ENSP ID: ENSP00000421779
CKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMTWCVSSI

SEQ ID NO: 78600 - protein, 1281 aa, Homo sapiens
  Payload ID: 15652
  Gene Symbol: SH3TC2
  Gene Name: SH3 domain and tetratricopeptide repeats 2
  Uniprot ID: Q8TF17
  ENSP ID: ENSP00000421860
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLEHLLFDHKYWLNCILVEDTEIQVSVDDKHLETIYLGLLIQEGHFFCRALCSVTPPAEKEGECLTLCKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSQLQATKSLCHFYSSVSPNPEACITYHEHWLALAQQLRDREMEGRLLESLGQLYRNLNTARSLRRSLTCIKESLRIFIDLGETDKAAEAWLGAGRLHYLMQEDELVELCLQAAIQTALKSEEPLLALKLYEEAGDVFFNGTRHRHHAVEYYRAGAVPLARRLKAVRTELRIFNKLTELQISLEGYEKALEFATLAARLSTVTGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 78601 - protein, 227 aa, Homo sapiens; identical to SEQ ID NO: 78596
  Payload ID: 15652
  Gene Symbol: SH3TC2
  Gene Name: SH3 domain and tetratricopeptide repeats 2
  ENSP ID: ENSP00000423111

SEQ ID NO: 78602 - protein, 1288 aa, Homo sapiens
  Payload ID: 15652
  Gene Symbol: SH3TC2
  Gene Name: SH3 domain and tetratricopeptide repeats 2
  Uniprot ID: Q8TF17
  ENSP ID: ENSP00000423660
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLGYVSMCLEHLLFDHKYWLNCILVEDTEIQVSVDDKHLETIYLGLLIQEGHFFCRALCSVTPPAEKEGECLTLCKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSQLQATKSLCHFYSSVSPNPEACITYHEHWLALAQQLRDREMEGRLLESLGQLYRNLNTARSLRRSLTCIKESLRIFIDLGETDKAAEAWLGAGRLHYLMQEDELVELCLQAAIQTALKSEEPLLALKLYEEAGDVFFNGTRHRHHAVEYYRAGAVPLARRLKAVRTELRIFNKLTELQISLEGYEKALEFATLAARLSTVTGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 78603 - protein, 37 aa, Homo sapiens
  Payload ID: 15652
  Gene Symbol: SH3TC2
  Gene Name: SH3 domain and tetratricopeptide repeats 2
  ENSP ID: ENSP00000423940
  MOD_RES (1)..(1): Any amino acid
XECSSFLHTLARTDITSVYRLSGFESIQNPPNDLSGE

SEQ ID NO: 78604 - protein, 1259 aa, Homo sapiens
  Payload ID: 15652
  Gene Symbol: SH3TC2
  Gene Name: SH3 domain and tetratricopeptide repeats 2
  ENSP ID: ENSP00000425627
MGGCFCIPRERSLTRGPGKETPSKDPTVSSECIASSEYKEKCFLPQNINPDLTLSFCVKSRSRRCVNGPLQEAARRRLWALENEDQEVRMLFKDLSARLVSIQSQRAQFLITFKTMEEIWKFSTYLNLGYVSMCLEHLLFDHKYWLNCILVEDTEIQVSVDDKHLETIYLGLLIQEGHFFCRALCSVTPPAEKEGECLTLCKNELISVKMAEAGSELEGVSLVTGQRGLVLVSALEPLPLPFHQWFLKNYPGSCGLSRKRDWTGSYQIGRGRCKALTGYEPGEKDELNFYQGESIEIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEEDEFVAYLEASRKWAKKSHMTWAHARLCFLLGRLSIRKVKLSQARVYFEEAIHILNGAFEDLSLVATLYINLAAIYLKQRLRHKGSALLEKAGALLACLPDRESSAKHELDVVAYVLRQGIVVGSSPLEARACFLAIRLLLSLGRHEEVLPFAERLQLLSGHPPASEAVASVLSFLYDKKYLPHLAVASVQQHGIQSAQGMSLPIWQVHLVLQNTTKLLGFPSPGWGEVSALACPMLRQALAACEELADRSTQRALCLILSKVYLEHRSPDGAIHYLSQALVLGQLLGEQESFESSLCLAWAYLLASQAKKALDVLEPLLCSLKETESLTQRGVIYNLLGLALQGEGRVNRAAKSYLRALNRAQEVGDVHNQAVAMANLGHLSLKSWAQHPARNYLLQAVRLYCELQASKETDMELVQVFLWLAQVLVSGHQLTHGLLCYEMALLFGLRHRHLKSQLQATKSLCHFYSSVSPNPEACITYHEHWLALAQQLRDREMEGRLLESLGQLYRNLNTARSLRRSLTCIKESLRIFIDLGETDKAAEAWLGAGRLHYLMQEDELVELCLQAAIQTALKSEEPLLALKLYEEAGDVFFNGTRHRHHAVEYYRAGAVPLARRLKAVRTELRIFNKLTELQISLEGYEKALEFATLAARLSTVTGDQRQELVAFHRLATVYYSLHMYEMAEDCYLKTLSLCPPWLQSPKEALYYAKVYYRLGRLTFCQLKFLLCCPGWSSVVQSGLPATSDSGAQVILQCQPPE

SEQ ID NO: 78605 - protein, 239 aa, Homo sapiens
  Payload ID: 15653
  Gene Symbol: SH3BGR
  Gene Name: SH3 domain binding glutamate-rich protein
  Uniprot ID: P55822
  ENSP ID: ENSP00000332513
MPLLLLGETEPLKLERDCRSPVDPWAAASPDLALACLCHCQDLSSGAFPDRGVLGGVLFPTVEMVIKVFVATSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEPGEDEDS

SEQ ID NO: 78606 - protein, 128 aa, Homo sapiens
  Payload ID: 15653
  Gene Symbol: SH3BGR
  Gene Name: SH3 domain binding glutamate-rich protein
  Uniprot ID: P55822
  ENSP ID: ENSP00000370005
MRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEPGEDEDS

SEQ ID NO: 78607 - protein, 128 aa, Homo sapiens; identical to SEQ ID NO: 78606
  Payload ID: 15653
  Gene Symbol: SH3BGR
  Gene Name: SH3 domain binding glutamate-rich protein
  Uniprot ID: P55822
  ENSP ID: ENSP00000370008

SEQ ID NO: 78608 - protein, 128 aa, Homo sapiens; identical to SEQ ID NO: 78606
  Payload ID: 15653
  Gene Symbol: SH3BGR
  Gene Name: SH3 domain binding glutamate-rich protein
  Uniprot ID: P55822
  ENSP ID: ENSP00000370011

SEQ ID NO: 78609 - protein, 106 aa, Homo sapiens
  Payload ID: 15653
  Gene Symbol: SH3BGR
  Gene Name: SH3 domain binding glutamate-rich protein
  ENSP ID: ENSP00000401572
MRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGA

SEQ ID NO: 78610 - protein, 54 aa, Homo sapiens
  Payload ID: 15653
  Gene Symbol: SH3BGR
  Gene Name: SH3 domain binding glutamate-rich protein
  ENSP ID: ENSP00000403115
GSEKAEEGGETEAQKEGSEDVGNLPEAQEKNKMEAMKQHFKCLSTNQTQQNTLA

SEQ ID NO: 78611 - protein, 97 aa, Homo sapiens
  Payload ID: 15653
  Gene Symbol: SH3BGR
  Gene Name: SH3 domain binding glutamate-rich protein
  ENSP ID: ENSP00000404980
MRENVPGEKKPQNGIPLPPQIFNEEQYCGDFDSFFSAKEENIIYSFLGLAPPPDSKEEEGETATEETEEIAMEGAEGEAEEEEETAEGEEPGEDEDS

SEQ ID NO: 78612 - protein, 137 aa, Homo sapiens
  Payload ID: 15653
  Gene Symbol: SH3BGR
  Gene Name: SH3 domain binding glutamate-rich protein
  ENSP ID: ENSP00000405675
  MOD_RES (1)..(1): Any amino acid
XSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKEEEGETATEETEEIAMEGAEGEAEEEEETAEGEEPGEDEDS

SEQ ID NO: 78613 - protein, 81 aa, Homo sapiens
  Payload ID: 15653
  Gene Symbol: SH3BGR
  Gene Name: SH3 domain binding glutamate-rich protein
  ENSP ID: ENSP00000413981
IFNEEQYCGGSEKAEEGGETEAQKEGSEDVGNLPEAQEKNEEEGETATEETEEIAMEGAEGEAEEEEETAEGEEPGEDEDS

SEQ ID NO: 78614 - protein, 114 aa, Homo sapiens
  Payload ID: 15654
  Gene Symbol: SH3BGRL
  Gene Name: SH3 domain binding glutamate-rich protein like
  Uniprot ID: O75368
  ENSP ID: ENSP00000362308
MVIRVYIASSSGSTAIKKKQQDVLGFLEANKIGFEEKDIAANEENRKWMRENVPENSRPATGYPLPPQIFNESQYRGDYDAFFEARENNAVYAFLGLTAPPGSKEAEVQAKQQA

SEQ ID NO: 78615 - protein, 107 aa, Homo sapiens
  Payload ID: 15655
  Gene Symbol: SH3BGRL2
  Gene Name: SH3 domain binding glutamate-rich protein like 2
  Uniprot ID: Q9UJC5
  ENSP ID: ENSP00000358853
MVIRVFIASSSGFVAIKKKQQDVVRFLEANKIEFEEVDITMSEEQRQWMYKNVPPEKKPTQGNPLPPQIFNGDRYCGDYDSFFESKESNTVFSFLGLKPRLASKAEP

SEQ ID NO: 78616 - protein, 93 aa, Homo sapiens
  Payload ID: 15656
  Gene Symbol: SH3BGRL3
  Gene Name: SH3 domain binding glutamate-rich protein like 3
  Uniprot ID: Q9H299
  ENSP ID: ENSP00000270792
MSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 78617 - protein, 88 aa, Homo sapiens
  Payload ID: 15656
  Gene Symbol: SH3BGRL3
  Gene Name: SH3 domain binding glutamate-rich protein like 3
  ENSP ID: ENSP00000363358
MSGLRVYSTSVTGSREIKSQQSEVTRILDGKRIQYQLVDISQDNALRDEMRALAGNPKATPPQIVNGDQYCGVWAGGRGGGGSVGRGL

SEQ ID NO: 78618 - protein, 226 aa, Homo sapiens
  Payload ID: 15656
  Gene Symbol: SH3BGRL3
  Gene Name: SH3 domain binding glutamate-rich protein like 3
  ENSP ID: ENSP00000479107
MHQTCVRLEREASARPSPGPVLPPRPLPSHTELQIREGPKRTIRAAAEGAPCVGRVRCAPGNRGGREGASGVRGGVAQVPPRLPAPPIGPERDDLAGGAGRKPLPSTAAASSPGSAAAATAALCPPARLSTPSMSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 78619 - protein, 424 aa, Homo sapiens
  Payload ID: 15657
  Gene Symbol: SBK1
  Gene Name: SH3 domain binding kinase 1
  Uniprot ID: Q52WX2
  ENSP ID: ENSP00000343248
MSVGCPEPEPPRSLTCCGPGTAPGPGAGVPLLTEDMQALTLRTLAASDVTKHYELVRELGKGTYGKVDLVVYKGTGTKMALKFVNKSKTKLKNFLREVSITNSLSSSPFIIKVFDVVFETEDCYVFAQEYAPAGDLFDIIPPQVGLPEDTVKRCVQQLGLALDFMHGRQLVHRDIKPENVLLFDRECRRVKLADFGMTRRVGCRVKRVSGTIPYTAPEVCQAGRADGLAVDTGVDVWAFGVLIFCVLTGNFPWEAASGADAFFEEFVRWQRGRLPGLPSQWRRFTEPALRMFQRLLALEPERRGPAKEVFRFLKHELTSELRRRPSHRARKPPGDRPPAAGPLRLEAPGPLKRTVLTESGSGSRPAPPAVGSVPLPVPVPVPVPVPVPVPEPGLAPQGPPGRTDGRADKSKGQVVLATAIEICV

SEQ ID NO: 78620 - protein, 348 aa, Homo sapiens
  Payload ID: 15658
  Gene Symbol: SBK2
  Gene Name: SH3 domain binding kinase family, member 2
  Uniprot ID: P0C263
  ENSP ID: ENSP00000345044
MPGKQSEEGPAEAGASEDSEEEGLGGLTLEELQQGQEAARALEDMMTLSAQTLVRAEVDELYEEVRPLGQGCYGRVLLVTHRQKGTPLALKQLPKPRTSLRGFLYEFCVGLSLGAHSAIVTAYGIGIESAHSYSFLTEPVLHGDLMAFIQPKVGLPQPAVHRCAAQLASALEYIHARGLVYRDLKPENVLVCDPACRRFKLTDFGHTRPRGTLLRLAGPPIPYTAPELCAPPPLPEGLPIQPALDAWALGVLLFCLLTGYFPWDRPLAEADPFYEDFLIWQASGQPRDRPQPWFGLAAAADALLRGLLDPHPRRRSAVIAIREHLGRPWRQREGEAEAVGAVEEEAGQ

SEQ ID NO: 78621 - protein, 348 aa, Homo sapiens; identical to SEQ ID NO: 78620
  Payload ID: 15658
  Gene Symbol: SBK2
  Gene Name: SH3 domain binding kinase family, member 2
  Uniprot ID: P0C263
  ENSP ID: ENSP00000389015

SEQ ID NO: 78622 - protein, 160 aa, Homo sapiens
  Payload ID: 15659
  Gene Symbol: SBK3
  Gene Name: SH3 domain binding kinase family, member 3
  ENSP ID: ENSP00000467263
TPEDGDPEVRDGSQGRKTEREKKEREAGGNTGRERKRNRKQGNAKTSETQTQGERMTEIQGHTARPRPPENWTQKHTAGCTGEEDGGERDQGGHSHSPPTAGGADDQQGDPGEEPSGPVPPHPEAGLRLLRPRAPCPASPGGSSCGSEAPASGFGPEKHL

SEQ ID NO: 78623 - protein, 359 aa, Homo sapiens
  Payload ID: 15659
  Gene Symbol: SBK3
  Gene Name: SH3 domain binding kinase family, member 3
  Uniprot ID: P0C264
  ENSP ID: ENSP00000483467
MERRASETPEDGDPEEDTATALQRLVELTTSRVTPVRSLRDQYHLIRKLGSGSYGRVLLAQPHQGGPAVALKLLRRDLVLRSTFLREFCVGRCVSAHPGLLQTLAGPLQTPRYFAFAQEYAPCGDLSGMLQERGLPELLVKRVVAQLAGALDFLHSRGLVHADVKPDNVLVFDPVCSRVALGDLGLTRPEGSPTPAPPVPLPTAPPELCLLLPPDTLPLRPAVDSWGLGVLLFCAATACFPWDVALAPNPEFEAFAGWVTTKPQPPQPPPPWDQFAPPALALLQGLLDLDPETRSPPLAVLDFLGDDWGLQGNREGPGVLGSAVSYEDREEGGSSLEEWTDEGDDSKSGGRTGTDGGAP

SEQ ID NO: 78624 - protein, 790 aa, Homo sapiens
  Payload ID: 15660
  Gene Symbol: SH3D19
  Gene Name: SH3 domain containing 19
  Uniprot ID: Q5HYK7
  ENSP ID: ENSP00000302913
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMLSVPHGIANEDIVSQNPGELSCKRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 78625 - protein, 790 aa, Homo sapiens; identical to SEQ ID NO: 78624
  Payload ID: 15660
  Gene Symbol: SH3D19
  Gene Name: SH3 domain containing 19
  Uniprot ID: Q5HYK7
  ENSP ID: ENSP00000386848

SEQ ID NO: 78626 - protein, 767 aa, Homo sapiens
  Payload ID: 15660
  Gene Symbol: SH3D19
  Gene Name: SH3 domain containing 19
  Uniprot ID: Q5HYK7
  ENSP ID: ENSP00000387030
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 78627 - protein, 731 aa, Homo sapiens
  Payload ID: 15660
  Gene Symbol: SH3D19
  Gene Name: SH3 domain containing 19
  Uniprot ID: Q5HYK7
  ENSP ID: ENSP00000415694
MNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLGLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 78628 - protein, 767 aa, Homo sapiens; identical to SEQ ID NO: 78626
  Payload ID: 15660
  Gene Symbol: SH3D19
  Gene Name: SH3 domain containing 19
  Uniprot ID: Q5HYK7
  ENSP ID: ENSP00000423449

SEQ ID NO: 78629 - protein, 1047 aa, Homo sapiens
  Payload ID: 15660
  Gene Symbol: SH3D19
  Gene Name: SH3 domain containing 19
  ENSP ID: ENSP00000488951
MAEGRRREDEEEELRERRELGGQRRARGRALSGHSAADRNERNKPEHRSSSQGPLSSIRAVIKRSSRTSIQSELHRDRRRPEITIVAAEPLRPASWFPGTPPPGLGFPTSSAAGSWRPNELVPAELPPSYEQVIKEINQVQVNTTNNNNAAATPRHTITSATQTDFSEEIDNDLPQTLQAPLKPLQPFSAVSSGNLPTNVAPLIVFDISEEPNCPENPSATRCPVPKPRSKSNLRPIPRDSHIKEQSQQKISPAAVGEESSPGRPQSLLDNASTSDSQAVMNIMNTEQSQNSIVSRIKVFEGQTNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDPFQLPAKTEPIKERAVQPAPTRKPTVIRIPAKPGKCLHEDPQSPPPLPAEKPIGNTFSTVSGKLSNVERTRNLESNHPGQTGGFVRVPPRLPPRPVNGKTIPTQQPPTKVPPERPPPPKLSATRRSNKKLPFNRSSSDMDLQKKQSNLATGLSKAKSQVFKNQDPVLPPRPKPGHPLYSKYMRGDVLVMLKQTENNYLECQKGEDTGRVHLSQMKIITPLDEHLRSRPNDPSHAQKPVDSGAPHAVVLHDFPAEQVDDLNLTSGEIVYLLEKIDTDWYRGNCRNQIGIFPANYVKVIIDIPEGGNGKRECVSSHCVKGSRCVARFEYIGEQKDELSFSEGEIIILKEYVNEEWARGEVRGRTGIFPLNFVEPVEDYPTSGANVLSTKVPLKTKKEDSGSNSQVNSLPAEWCEALHSFTAETSDDLSFKRGDRIQILERLDSDWCRGRLQDREGIFPAVFVRPCPAEAKSMLAIVPKGRKAKALYDFRGENEDELSFKAGDIITELESVDDDWMSGELMGKSGIFPKNYIQFLQIS

SEQ ID NO: 78630 - protein, 233 aa, Homo sapiens
  Payload ID: 15660
  Gene Symbol: SH3D19
  Gene Name: SH3 domain containing 19
  ENSP ID: ENSP00000489087
  MOD_RES (1)..(1): Any amino acid
XNIETSGLPKKPEITPRSLPPKPTVSSGKPSVAPKPAANRASGEWDSGTENRLKVTSKEGLTPYPPLQEAGSIPVTKPELPKKPNPGLIRSVNPEIPGRGPLAESSDSGKKVPTPAPRPLLLKKSVSSENPTYPSAPLKPVTVPPRLAGASQAKAYKSLGEGPPANPPVPVLQSKPLVDIDLISFDDDVLPTPSGNLAEESVGSEMVLDHVEALPLTRELINNLFKRAEHKHN

SEQ ID NO: 78631 - protein, 378 aa, Homo sapiens
  Payload ID: 15661
  Gene Symbol: SH3D21
  Gene Name: SH3 domain containing 21
  ENSP ID: ENSP00000362232
MEVLVLAGYRAQKEDELSLAPGDVVRQVRWVPARGWLRGEFGGRYGLFPERLVQEIPETLRGSGEARRPRCARRRGHPAKHPRPQRWCKVNFSYSPEQADELKLQAGEIVEMIKEIEDGWWLGKKNGQLGAFPSNFVELLDSGPPSLGNPDMPSVSPGPQRPPKLSSLAYDSPPDYLQTVSHPEVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIP

SEQ ID NO: 78632 - protein, 756 aa, Homo sapiens
  Payload ID: 15661
  Gene Symbol: SH3D21
  Gene Name: SH3 domain containing 21
  Uniprot ID: A4FU49
  ENSP ID: ENSP00000403476
MEVLVLAGYRAQKEDELSLAPGDVVRQVRWVPARGWLRGEFGGRYGLFPERLVQEIPETLRGSGEARRPRCARRRGHPAKHPRPQRWCKVNFSYSPEQADELKLQAGEIVEMIKEIEDGWWLGKKNGQLGAFPSNFVELLDSGPPSLGNPDMPSVSPGPQRPPKLSSLAYDSPPDYLQTVSHPEVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 78633 - protein, 645 aa, Homo sapiens
  Payload ID: 15661
  Gene Symbol: SH3D21
  Gene Name: SH3 domain containing 21
  Uniprot ID: A4FU49
  ENSP ID: ENSP00000421294
MIKEIEDGWWLGKKNGQLGAFPSNFVELLDSGPPSLGNPDMPSVSPGPQRPPKLSSLAYDSPPDYLQTVSHPEVYRVLFDYQPEAPDELALRRGDVVKVLSKTTEDKGWWEGECQGRRGVFPDNFVLPPPPIKKLVPRKVVSRESAPIKEPKKLMPKTSLPTVKKLATATTGPSKAKTSRTPSRDSQKLTSRDSGPNGGFQSGGSYHPGRKRSKTQTPQQRSVSSQEEEHSSPVKAPSVKRTPMPDKTATPERPPAPENAPSSKKIPAPDKVPSPEKTLTLGDKASIPGNSTSGKIPAPDKVPTPEKMVTPEDKASIPENSIIPEETLTVDKPSTPERVFSVEESPALEAPPMDKVPNPKMAPLGDEAPTLEKVLTPELSEEEVSTRDDIQFHHFSSEEALQKVKYFVAKEDPSSQEEAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKTRPIKPPPDSQETLALPSLVPQNYTENKNEGVDVTSLRGEVESLRRALELMEVQLERKLTDIWEELKSEKEQRRRLEVQVMQGTQKSQTPRVIHTQTQTY

SEQ ID NO: 78634 - protein, 135 aa, Homo sapiens
  Payload ID: 15661
  Gene Symbol: SH3D21
  Gene Name: SH3 domain containing 21
  ENSP ID: ENSP00000425484
MIKEIEDGWWLGKKNGQLGAFPSNFVELLDSGPPSLGNPDMPSVSPGPQRPPKTTEDKGWWEGECQGRRGVFPDNFVLPPPPIKKLVPRKVVSRESAPIKEPKKLMPKTSLPTVKKLATATTGPSKAKRKSTAAR

SEQ ID NO: 78635 - protein, 888 aa, Homo sapiens
  Payload ID: 15662
  Gene Symbol: SH3RF1
  Gene Name: SH3 domain containing ring finger 1
  Uniprot ID: Q7Z6J0
  ENSP ID: ENSP00000284637
MDESALLDLLECPVCLERLDASAKVLPCQHTFCKRCLLGIVGSRNELRCPECRTLVGSGVEELPSNILLVRLLDGIKQRPWKPGPGGGSGTNCTNALRSQSSTVANCSSKDLQSSQGGQQPRVQSWSPPVRGIPQLPCAKALYNYEGKEPGDLKFSKGDIIILRRQVDENWYHGEVNGIHGFFPTNFVQIIKPLPQPPPQCKALYDFEVKDKEADKDCLPFAKDDVLTVIRRVDENWAEGMLADKIGIFPISYVEFNSAAKQLIEWDKPPVPGVDAGECSSAAAQSSTAPKHSDTKKNTKKRHSFTSLTMANKSSQASQNRHSMEISPPVLISSSNPTAAARISELSGLSCSAPSQVHISTTGLIVTPPPSSPVTTGPSFTFPSDVPYQAALGTLNPPLPPPPLLAATVLASTPPGATAAAAAAGMGPRPMAGSTDQIAHLRPQTRPSVYVAIYPYTPRKEDELELRKGEMFLVFERCQDGWFKGTSMHTSKIGVFPGNYVAPVTRAVTNASQAKVPMSTAGQTSRGVTMVSPSTAGGPAQKLQGNGVAGSPSVVPAAVVSAAHIQTSPQAKVLLHMTGQMTVNQARNAVRTVAAHNQERPTAAVTPIQVQNAAGLSPASVGLSHHSLASPQPAPLMPGSATHTAAISISRASAPLACAAAAPLTSPSITSASLEAEPSGRIVTVLPGLPTSPDSASSACGNSSATKPDKDSKKEKKGLLKLLSGASTKRKPRVSPPASPTLEVELGSAELPLQGAVGPELPPGGGHGRAGSCPVDGDGPVTTAVAGAALAQDAFHRKASSLDSAVPIAPPPRQACSSLGPVLNESRPVVCERHRVVVSYPPQSEAELELKEGDIVFVHKKREDGWFKGTLQRNGKTGLFPGSFVENI

SEQ ID NO: 78636 - protein, 79 aa, Homo sapiens
  Payload ID: 15662
  Gene Symbol: SH3RF1
  Gene Name: SH3 domain containing ring finger 1
  ENSP ID: ENSP00000421714
MDESALLDLLECPVCLERLDASAKVLPCQHTFCKRCLLGIVGSRNELRCPECRTLVGSGVEELPSNILLVRLLDGIKQR

SEQ ID NO: 78637 - protein, 303 aa, Homo sapiens
  Payload ID: 15662
  Gene Symbol: SH3RF1
  Gene Name: SH3 domain containing ring finger 1
  ENSP ID: ENSP00000426418
  MOD_RES (1)..(1): Any amino acid
XKALYNYEGKEPGDLKFSKGDIIILRRQVDENWYHGEVNGIHGFFPTNFVQIIKPLPQPPPQCKALYDFEVKDKEADKDCLPFAKDDVLTVIRRVDENWAEGMLADKIGIFPISYVEFNSAAKQLIEWDKPPVPGVDAGECSSAAAQSSTAPKHSDTKKNTKKRHSFTSLTMANKSSQASQNRHSMEISPPVLISSSNPTAAARISELSGLSCSAPSQVHISTTGLIVTPPPSSPVTTGPSFTFPSDVPYQAALGAPPPLLLLLEWDRGPWQDPLTRLHIYGRRLAPVCMLLYIHTLLGKRMN

SEQ ID NO: 78638 - protein, 99 aa, Homo sapiens
  Payload ID: 15662
  Gene Symbol: SH3RF1
  Gene Name: SH3 domain containing ring finger 1
  ENSP ID: ENSP00000427585
MDESALLDLLECPVCLERLDASAKVLPCQHTFCKRCLLGIVGSRNELRCPECRTLVGSGVEELPSNILLVRLLDGIKQRPWKPGPGGGSGTNCTNALRS

SEQ ID NO: 78639 - protein, 729 aa, Homo sapiens
  Payload ID: 15663
  Gene Symbol: SH3RF2
  Gene Name: SH3 domain containing ring finger 2
  Uniprot ID: Q8TEC5
  ENSP ID: ENSP00000352028
MDDLTLLDLLECPVCFEKLDVTAKVLPCQHTFCKPCLQRVFKAHKELRCPECRTPVFSNIEALPANLLLVRLLDGVRSGQSSGRGGSFRRPGTMTLQDGRKSRTNPRRLQASPFRLVPNVRIHMDGVPRAKALCNYRGQNPGDLRFNKGDIILLRRQLDENWYQGEINGISGNFPASSVEVIKQLPQPPPLCRALYNFDLRGKDKSENQDCLTFLKDDIITVISRVDENWAEGKLGDKVGIFPILFVEPNLTARHLLEKNKGRQSSRTKNLSLVSSSSRGNTSTLRRGPGSRRKVPGQFSITTALNTLNRMVHSPSGRHMVEISTPVLISSSNPSVITQPMEKADVPSSCVGQVSTYHPAPVSPGHSTAVVSLPGSQQHLSANMFVALHSYSAHGPDELDLQKGEGVRVLGKCQDGWLRGVSLVTGRVGIFPNNYVIPIFRKTSSFPDSRSPGLYTTWTLSTSSVSSQGSISEGDPRQSRPFKSVFVPTAIVNPVRSTAGPGTLGQGSLRKGRSSMRKNGSLQRPLQSGIPTLVVGSLRRSPTMVLRPQQFQFYQPQGIPSSPSAVVVEMGSKPALTGEPALTCISRGSEAWIHSAASSLIMEDKEIPIKSEPLPKPPASAPPSILVKPENSRNGIEKQVKTVRFQNYSPPPTKHYTSHPTSGKPEQPATLKASQPEAASLGPEMTVLFAHRSGCHSGQQTDLRRKSALGKATTLVSTASGTQTVFPSK

SEQ ID NO: 78640 - protein, 729 aa, Homo sapiens; identical to SEQ ID NO: 78639
  Payload ID: 15663
  Gene Symbol: SH3RF2
  Gene Name: SH3 domain containing ring finger 2
  Uniprot ID: Q8TEC5
  ENSP ID: ENSP00000424497

SEQ ID NO: 78641 - protein, 882 aa, Homo sapiens
  Payload ID: 15664
  Gene Symbol: SH3RF3
  Gene Name: SH3 domain containing ring finger 3
  Uniprot ID: Q8TEJ3
  ENSP ID: ENSP00000309186
MLLGASWLCASKAAAAAAQSEGDEDRPGERRRRRAAATAAGAGEDMDESSLLDLLECSVCLERLDTTAKVLPCQHTFCRRCLESIVCSRHELRCPECRILVGCGVDELPANILLVRLLDGIRQRPRAGTSPGGSPPARPIPGQSAAPTLAGGGGGAAGSTPGSPVFLSAAAGSTAGSLRELATSRTAPAAKNPCLLPYGKALYSYEGKEPGDLKFNKGDIIVLRRKVDEQWYHGELHGTQGFLPASYIQCIQPLPHAPPQGKALYDFEMKDKDQDKDCLTFTKDEILTVLRRVDENWAEGMLGDKIGIFPLLYVELNDSAKQLIEMDKPCPAAASSCNASLPSDSGAVASVAPSPTLSSSGAVSAFQRRVDGKKNTKKRHSFTALSVTHRSSQAASHRHSMEISAPVLISSSDPRAAARIGDLAHLSCAAPTQDVSSSAGSTPTAVPRAASVSGEQGTPPKVQLPLNVYLALYAYKPQKSDELELHKGEMYRVLEKCQDGWFKGASLRTGVSGVFPGNYVTPVSRVPAGGAGPPRNNVVGGSPLAKGITTTMHPGSGSLSSLATATRPALPITTPQAHAQHPTASPPTGSCLRHSAQPTASQARSTISTAAHSAAQAQDRPTATVSPLRTQNSPSRLPATSLRPHSVVSPQHSHQPPVQMCPRPAIPLTSAASAITPPNVSAANLNGEAGGGPIGVLSTSSPTNTGCKLDEKKSEKKEKKSGLLKLLAGASTKKKSRSPPSVSPTHDPQVAVDALLQGAVGPEVSSLSIHGRAGSCPIESEMQGAMGMEPLHRKAGSLDLNFTSPSRQAPLSMAAIRPEPKLLPRERYRVVVSYPPQSEAEIELKEGDIVFVHKKREDGWYKGTLQRNGRTGLFPGSFVESF

SEQ ID NO: 78642 - protein, 393 aa, Homo sapiens [sequence omitted]

SEQ ID NO: 78643 - protein, 701 aa, Homo sapiens
  Payload ID: 15666
  Gene Symbol: SH3BP1
  Gene Name: SH3-domain binding protein 1
  Uniprot ID: Q9Y3L3
  ENSP ID: ENSP00000350018
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKERTESEVPPRPASPKVTRSPPETAAPVEDMARRTKRPAPARPTMPPPQVSGSRSSPPAPPLPPGSGSPGTPQALPRRLVGSSLRAPTVPPPLPPTPPQPARRQSRRSPASPSPASPGPASPSPVSLSNPAQVDLGAATAEGGAPEAISGVPTPPAIPPQPRPRSLASETN

SEQ ID NO: 78644 - protein, 20 aa, Homo sapiens
  Payload ID: 15666
  Gene Symbol: SH3BP1
  Gene Name: SH3-domain binding protein 1
  ENSP ID: ENSP00000401076
MMKRQLHRMRQLAQTGSLGR

SEQ ID NO: 78645 - protein, 452 aa, Homo sapiens
  Payload ID: 15666
  Gene Symbol: SH3BP1
  Gene Name: SH3-domain binding protein 1
  Uniprot ID: Q9Y3L3
  ENSP ID: ENSP00000411979
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGTEPARELGSQTLC

SEQ ID NO: 78646 - protein, 561 aa, Homo sapiens
  Payload ID: 15667
  Gene Symbol: SH3BP2
  Gene Name: SH3-domain binding protein 2
  Uniprot ID: P78314
  ENSP ID: ENSP00000348685
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 78647 - protein, 589 aa, Homo sapiens
  Payload ID: 15667
  Gene Symbol: SH3BP2
  Gene Name: SH3-domain binding protein 2
  Uniprot ID: P78314
  ENSP ID: ENSP00000388152
MASLGPRTPAPSRSRGRRAMCWVSTISFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 78648 - protein, 561 aa, Homo sapiens; identical to SEQ ID NO: 78646
  Payload ID: 15667
  Gene Symbol: SH3BP2
  Gene Name: SH3-domain binding protein 2
  Uniprot ID: P78314
  ENSP ID: ENSP00000403231

SEQ ID NO: 78649 - protein, 561 aa, Homo sapiens; identical to SEQ ID NO: 78646
  Payload ID: 15667
  Gene Symbol: SH3BP2
  Gene Name: SH3-domain binding protein 2
  Uniprot ID: P78314
  ENSP ID: ENSP00000409746

SEQ ID NO: 78650 - protein, 618 aa, Homo sapiens
  Payload ID: 15667
  Gene Symbol: SH3BP2
  Gene Name: SH3-domain binding protein 2
  Uniprot ID: P78314
  ENSP ID: ENSP00000422168
MAGSGPRPRSWGRREAGARDEAAAAGGRGPGPCRCSQGRRAWIAPGKPAMPAAWTPFMAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRLEDALMHPPAYPPPPVPTPRKPAFSDMPRAHSFTSKGPGPLLPPPPPKHGLPDVGLAAEDSKRDPLCPRRAEPCPRVPATPRRMSDPPLSTMPTAPGLRKPPCFRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVPLPNSVFVNTTESCEVERLFKATSPRGEPQDGLYCIRNSSTKSGKVLVVWDETSNKVRNYRIFEKDSKFYLEGEVLFVSVGSMVEHYHTHVLPSHQSLLLRHPYGYTGPR

SEQ ID NO: 78651 - protein, 97 aa, Homo sapiens
  Payload ID: 15667
  Gene Symbol: SH3BP2
  Gene Name: SH3-domain binding protein 2
  Uniprot ID: P78314
  ENSP ID: ENSP00000422605
MAAEEMHWPVPMKAIGAQNLLTMPGGVAKAGYLHKKGGTQLQLLKWPLRFVIIHKRCVYYFKSSTSASPQGAFSLSGYNRQPRPQPAQALSQTEAGP

SEQ ID NO: 78652 - protein, 142 aa, Homo sapiens
  Payload ID: 15667
  Gene Symbol: SH3BP2
  Gene Name: SH3-domain binding protein 2
  ENSP ID: ENSP00000422796
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDT

SEQ ID NO: 78653 - protein, 172 aa, Homo sapiens
  Payload ID: 15667
  Gene Symbol: SH3BP2
  Gene Name: SH3-domain binding protein 2
  ENSP ID: ENSP00000423275
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNE

SEQ ID NO: 78654 - protein, 136 aa, Homo sapiens
  Payload ID: 15667
  Gene Symbol: SH3BP2
  Gene Name: SH3-domain binding protein 2
  ENSP ID: ENSP00000423823
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKK

SEQ ID NO: 78655 - protein, 97 aa, Homo sapiens; identical to SEQ ID NO: 78651
  Payload ID: 15667
  Gene Symbol: SH3BP2
  Gene Name: SH3-domain binding protein 2
  Uniprot ID: P78314
  ENSP ID: ENSP00000424072

SEQ ID NO: 78656 - protein, 194 aa, Homo sapiens
  Payload ID: 15667
  Gene Symbol: SH3BP2
  Gene Name: SH3-domain binding protein 2
  ENSP ID: ENSP00000424105
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDSPEPGRL

SEQ ID NO: 78657 - protein, 561 aa, Homo sapiens; identical to SEQ ID NO: 78646
  Payload ID: 15667
  Gene Symbol: SH3BP2
  Gene Name: SH3-domain binding protein 2
  Uniprot ID: P78314
  ENSP ID: ENSP00000424846

SEQ ID NO: 78658 - protein, 188 aa, Homo sapiens
  Payload ID: 15667
  Gene Symbol: SH3BP2
  Gene Name: SH3-domain binding protein 2
  ENSP ID: ENSP00000424917
MAAEEMHWPVPMKAIGAQNLLTMPGGVAKAGYLHKKGGTQLQLLKWPLRFVIIHKRCVYYFKSSTSASPQGAFSLSGYNRVMRAAEETTSNNVFPFKIIHISKKHRTWFFSASSEEERKSWMALLRREIGHFHEKKDLPLDTSDSSSDTDSFYGAVERPVDISLSPYPTDNEDYEHDDEDDSYLEPDS

SEQ ID NO: 78659 - protein, 142 aa, Homo sapiens; identical to SEQ ID NO: 78652
  Payload ID: 15667
  Gene Symbol: SH3BP2
  Gene Name: SH3-domain binding protein 2
  ENSP ID: ENSP00000425537

SEQ ID NO: 78660 - protein, 190 aa, Homo sapiens
  Payload ID: 15667
  Gene Symbol: SH3BP2
  Gene Name: SH3-domain binding protein 2
  ENSP ID: ENSP00000426818
  MOD_RES (1)..(1): Any amino acid
XRESASPSPEPWTPGHGACSTSSAAIMATATSRNCDKLKSFHLSPRGPPTSEPPPVPANKPKFLKIAEEDPPREAAMPGLFVPPVAPRPPALKLPVPEAMARPAVLPRPEKPQLPHLQRSPPDGQSFRSFSFEKPRQPSQADTGGDDSDEDYEKVVQGYKPPGRAPGWTLLHPELLYQVGEGPGCVGRNL

SEQ ID NO: 78661 - protein, 963 aa, Homo sapiens
  Payload ID: 15668
  Gene Symbol: SH3BP4
  Gene Name: SH3-domain binding protein 4
  Uniprot ID: Q9P0V3
  ENSP ID: ENSP00000340237
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNGNVPVMPSLDELNPKSTVDLLLFDAGTSSFTESSSATTNSTGNIFDELPVTNGLHAEPPVRRDNPFFRSKRSYSLSELSVLQAKSDAPTSSSFFTGLKSPAPEQFQSREDFRTAWLNHRKLARSCHDLDLLGQSPGWGQTQAVETNIVCKLDSSGGAVQLPDTSISIHVPEGHVAPGETQQISMKALLDPPLELNSDRSCSISPVLEVKLSNLEVKTSIILEMKVSAEIKNDLFSKSTVGLQCLRSDSKEGPYVSVPLNCSCGDTVQAQLHNLEPCMYVAVVAHGPSILYPSTVWDFINKKVTVGLYGPKHIHPSFKTVVTIFGHDCAPKTLLVSEVTRQAPNPAPVALQLWGKHQFVLSRPQDLKVCMFSNMTNYEVKASEQAKVVRGFQLKLGKVSRLIFPITSQNPNELSDFTLRVQVKDDQEAILTQFCVQTPQPPPKSAIKPSGQRRFLKKNEVGKIILSPFATTTKYPTFQDRPVSSLKFGKLLKTVVRQNKNHYLLEYKKGDGIALLSEERVRLRGQLWTKEWYIGYYQGRVGLVHTKNVLVVGRARPSLCSGPELSTSVLLEQILRPCKFLTYIYASVRTLLMENISSWRSFADALGYVNLPLTFFCRAELDSEPERVASVLEKLKEDCNNTENKERKSFQKELVMALLKMDCQGLVVRLIQDFVLLTTAVEVAQRWRELAEKLAKVSKQQMDAYESPHRDRNGVVDSEAMWKPAYDFLLTWSHQIGDSYRDVIQELHLGLDKMKNPITKRWKHLTGTLILVNSLDVLRAAAFSPADQDDFVI

SEQ ID NO: 78662 - protein, 963 aa, Homo sapiens; identical to SEQ ID NO: 78661
  Payload ID: 15668
  Gene Symbol: SH3BP4
  Gene Name: SH3-domain binding protein 4
  Uniprot ID: Q9P0V3
  ENSP ID: ENSP00000375867

SEQ ID NO: 78663 - protein, 963 aa, Homo sapiens; identical to SEQ ID NO: 78661
  Payload ID: 15668
  Gene Symbol: SH3BP4
  Gene Name: SH3-domain binding protein 4
  Uniprot ID: Q9P0V3
  ENSP ID: ENSP00000386862

SEQ ID NO: 78664 - protein, 56 aa, Homo sapiens
  Payload ID: 15668
  Gene Symbol: SH3BP4
  Gene Name: SH3-domain binding protein 4
  ENSP ID: ENSP00000387995
MAAQRIRAANSNGLPRCKSEGTLIDLSEGFSETSFNDIKVPSPSALLVDNPTPFGN

SEQ ID NO: 78665 - protein, 122 aa, Homo sapiens
  Payload ID: 15668
  Gene Symbol: SH3BP4
  Gene Name: SH3-domain binding protein 4
  ENSP ID: ENSP00000403251
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDS

SEQ ID NO: 78666 - protein, 57 aa, Homo sapiens
  Payload ID: 15668
  Gene Symbol: SH3BP4
  Gene Name: SH3-domain binding protein 4
  ENSP ID: ENSP00000414740
MAAQRIRAANSNGLPRCKSEGTLIDLSEGFSETSFNDIKVPSPSALLVDNPTPFGNA

SEQ ID NO: 78667 - protein, 173 aa, Homo sapiens
  Payload ID: 15668
  Gene Symbol: SH3BP4
  Gene Name: SH3-domain binding protein 4
  ENSP ID: ENSP00000415391
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNG

SEQ ID NO: 78668 - protein, 455 aa, Homo sapiens
  Payload ID: 15669
  Gene Symbol: SH3BP5
  Gene Name: SH3-domain binding protein 5 (BTK-associated)
  Uniprot ID: O60239
  ENSP ID: ENSP00000373301
MDAALKRSRSEEPAEILPPARDEEEEEEEGMEQGLEEEEEVDPRIQGELEKLNQSTDDINRRETELEDARQKFRSVLVEATVKLDELVKKIGKAVEDSKPYWEARRVARQAQLEAQKATQDFQRATEVLRAAKETISLAEQRLLEDDKRQFDSAWQEMLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 78669 - protein, 298 aa, Homo sapiens
  Payload ID: 15669
  Gene Symbol: SH3BP5
  Gene Name: SH3-domain binding protein 5 (BTK-associated)
  Uniprot ID: O60239
  ENSP ID: ENSP00000386231
MLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDLPGSKPEPDAISVASEAFEDDSCSNFVSEDDSETQSVSSFSSGPTSPSEMPDQFPAVVRPGSLDLPSPVSLSEFGMMFPVLGPRSECSGASSPECEVERGDRAEGAENKTSDKANNNRGLSSSSGSGGSSKSQSSTSPEGQALENRMKQLSLQCSKGRDGIIADIKMVQIG

SEQ ID NO: 78670 - protein, 298 aa, Homo sapiens; identical to SEQ ID NO: 78669
  Payload ID: 15669
  Gene Symbol: SH3BP5
  Gene Name: SH3-domain binding protein 5 (BTK-associated)
  Uniprot ID: O60239
  ENSP ID: ENSP00000388553

SEQ ID NO: 78671 - protein, 69 aa, Homo sapiens
  Payload ID: 15669
  Gene Symbol: SH3BP5
  Gene Name: SH3-domain binding protein 5 (BTK-associated)
  ENSP ID: ENSP00000389484
MDAALKRSRSEEPAEILPPARDEEEEEEEGMEQGLEEEEEVDPRIQGELEKLNQSTDDINRRETELEVQ

SEQ ID NO: 78672 - protein, 128 aa, Homo sapiens
  Payload ID: 15669
  Gene Symbol: SH3BP5
  Gene Name: SH3-domain binding protein 5 (BTK-associated)
  ENSP ID: ENSP00000394115
MLNHATQRVMEAEQTKTRSELVHKETAARYNAAMGRMRQLEKKLKRAINKSKPYFELKAKYYVQLEQLKKTVDDLQAKLTLAKGEYKMALKNLEMISDEIHERRRSSAMGPRGCGVGAEGSSTSVEDL

SEQ ID NO: 78673 - protein, 57 aa, Homo sapiens
  Payload ID: 15669
  Gene Symbol: SH3BP5
  Gene Name: SH3-domain binding protein 5 (BTK-associated)
  ENSP ID: ENSP00000400128
MDAALKRSRSEEPAEILPPARDEEEEEEEGMEQGLEEEEEVDPRIQHICGGSAREQT

SEQ ID NO: 78674 - protein, 51 aa, Homo sapiens
  Payload ID: 15669
  Gene Symbol: SH3BP5
  Gene Name: SH3-domain binding protein 5 (BTK-associated)
  ENSP ID: ENSP00000408246
MLNHATQRVMEAEQTKTRSELVHKETAARYNAAMGRMRQLEKKLKRAINKS

SEQ ID NO: 78675 - protein, 859 aa, Homo sapiens
  Payload ID: 15670
  Gene Symbol: SGIP1
  Gene Name: SH3-domain GRB2-like (endophilin) interacting protein 1
  Uniprot ID: Q9BQI5
  ENSP ID: ENSP00000237247
MMEGLKKRTRKAFGIRKKEKDTDSTGSPDRDGIQGKKKTQKTQLLLTSCFWLRALSLTLSQKKSNGAPNGFYAEIDWERYNSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGNDQSATEVKIEKLPSINDLDSIFGPVLSPKSVAVNAEEKWVHFSDTSPEHVTPELTPREKVVSPPATPDNPADSPAPGPLGPPGPTGPPGPPGPPRNVLSPLNLEEVQKKVAEQTFIKDDYLETISSPKDFGLGQRATPPPPPPPTYRTVVSSPGPGSGPGPGTTSDGKTEAQRYQVICPSLQAGGNELDSYSGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 78676 - protein, 828 aa, Homo sapiens
  Payload ID: 15670
  Gene Symbol: SGIP1
  Gene Name: SH3-domain GRB2-like (endophilin) interacting protein 1
  Uniprot ID: Q9BQI5
  ENSP ID: ENSP00000360076
MMEGLKKRTRKAFGIRKKEKDTDSTGSPDRDGIQPSPHEPPYNSKAECAREGGKKVSKKSNGAPNGFYAEIDWERYNSPELDEEGYSIRPEEPGSTKGKHFYSSSESEEEEESHKKFNIKIKPLQSKDILKNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGNDQSATEVKIEKLPSINDLDSIFGPVLSPKSVAVNAEEKWVHFSDTSPEHVTPELTPREKVVSPPATPDNPADSPAPGPLGPPGPTGPPGPPGPPRNVLSPLNLEEVQKKVAEQTFIKDDYLETISSPKDFGLGQRATPPPPPPPTYRTVVSSPGPGSGPGPGTTSGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 78677 - protein, 631 aa, Homo sapiens
  Payload ID: 15670
  Gene Symbol: SGIP1
  Gene Name: SH3-domain GRB2-like (endophilin) interacting protein 1
  Uniprot ID: Q9BQI5
  ENSP ID: ENSP00000360078
MMEGLKKRTRKAFGIRKKEKDTDSTGSPDRDGIKKSNGAPNGFYAEIDWERYNSPELDEEGYSIRPEEPGSTKGKHFYSSSESEEEEESHKKFNIKIKPLQSKDILKNAATVDELKASIGNIALSPSPVGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVVSEDDVFYDKLPSFERRCETPAGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 78678 - protein, 333 aa, Homo sapiens
  Payload ID: 15670
  Gene Symbol: SGIP1
  Gene Name: SH3-domain GRB2-like (endophilin) interacting protein 1
  ENSP ID: ENSP00000395525
MTCSVTHIVSFSLPFLNPSHPASTPGHTENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 78679 - protein, 260 aa, Homo sapiens
  Payload ID: 15670
  Gene Symbol: SGIP1
  Gene Name: SH3-domain GRB2-like (endophilin) interacting protein 1
  ENSP ID: ENSP00000410439
MMEGLKKRTRKAFGIRKKEKDTDSTGSPDRDGIQPSPHEPPYNSKAECAREGGKKVSKKSNGAPNGFYAEIDWERYNSPELDEEGYSIRPEEPGSTKGKHFYSSSESEEEEESHKKFNIKIKPLQSKDILKNAATVDELKASIGNIALSPSPVGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLT

SEQ ID NO: 78680 - protein, 368 aa, Homo sapiens
  Payload ID: 15671
  Gene Symbol: SH3GL1
  Gene Name: SH3-domain GRB2-like 1
  Uniprot ID: Q99961
  ENSP ID: ENSP00000269886
MSVAGLKKQFYKASQLVSEKVGGAEGTKLDDDFKEMEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 78681 - protein, 320 aa, Homo sapiens
  Payload ID: 15671
  Gene Symbol: SH3GL1
  Gene Name: SH3-domain GRB2-like 1
  Uniprot ID: Q99961
  ENSP ID: ENSP00000404568
MSVAGLKKQFYKASQLVSEKVGGAEGTKLDDDFKEMEKKVDVTSKAVTEVLARTIEYLQPNPGDALLDAGESMKRLAEVKDSLDIEVKQNFIDPLQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 78682 - protein, 128 aa, Homo sapiens
  Payload ID: 15671
  Gene Symbol: SH3GL1
  Gene Name: SH3-domain GRB2-like 1
  ENSP ID: ENSP00000469766
MEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEG

SEQ ID NO: 78683 - protein, 304 aa, Homo sapiens
  Payload ID: 15671
  Gene Symbol: SH3GL1
  Gene Name: SH3-domain GRB2-like 1
  Uniprot ID: Q99961
  ENSP ID: ENSP00000470792
MSVAGLKKQFYKASQLVSEKVGGAEGTKLDDDFKEMEKKVDVTSKAVTEVLARTIEYLQPNPASRAKLTMLNTVSKIRGQNLCEKDLKEIQHHLKKLEGRRLDFDYKKKRQGKIPDEELRQALEKFEESKEVAETSMHNLLETDIEQVSQLSALVDAQLDYHRQAVQILDELAEKLKRRMREASSRPKREYKPKPREPFDLGEPEQSNGGFPCTTAPKIAASSSFRSSDKPIRTPSRSMPPLDQPSCKALYDFEPENDGELGFHEGDVITLTNQIDENWYEGMLDGQSGFFPLSYVEVLVPLPQ

SEQ ID NO: 78684 - protein, 139 aa, Homo sapiens
  Payload ID: 15671
  Gene Symbol: SH3GL1
  Gene Name: SH3-domain GRB2-like 1
  ENSP ID: ENSP00000471260
MEKKVDVTSKAVTEVLARTIEYLQPNPASRAKLTMLNTVSKIRGQVKNPGYPQSEGLLGECMIRHGKELGGESNFGDALLDAGESMKRLAEVKDSLDIEVKQNFIDPLQNLCEKDLKEIQHHLKKLEGRRLDFDYKKKR

SEQ ID NO: 78685 - protein, 26 aa, Homo sapiens
  Payload ID: 15671
  Gene Symbol: SH3GL1
  Gene Name: SH3-domain GRB2-like 1
  ENSP ID: ENSP00000472640
MEKKVDVTSKAVTEVLARTIEYLQPN

SEQ ID NO: 78686 - protein, 352 aa, Homo sapiens
  Payload ID: 15672
  Gene Symbol: SH3GL2
  Gene Name: SH3-domain GRB2-like 2
  Uniprot ID: Q99962
  ENSP ID: ENSP00000369981
MSVAGLKKQFHKATQKVSEKVGGAEGTKLDDDFKEMERKVDVTSRAVMEIMTKTIEYLQPNPASRAKLSMINTMSKIRGQEKGPGYPQAEALLAEAMLKFGRELGDDCNFGPALGEVGEAMRELSEVKDSLDIEVKQNFIDPLQNLHDKDLREIQHHLKKLEGRRLDFDYKKKRQGKIPDEELRQALEKFDESKEIAESSMFNLLEMDIEQVSQLSALVQAQLEYHKQAVQILQQVTVRLEERIRQASSQPRREYQPKPRMSLEFPTGDSTQPNGGLSHTGTPKPSGVQMDQPCCRALYDFEPENEGELGFKEGDIITLTNQIDENWYEGMLHGHSGFFPINYVEILVALPH

SEQ ID NO: 78687 - protein, 355 aa, Homo sapiens
  Payload ID: 15673
  Gene Symbol: SH3GL3
  Gene Name: SH3-domain GRB2-like 3
  Uniprot ID: Q99963
  ENSP ID: ENSP00000320092
MDGIFAGIICNQANRCLTWTSQQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 78688 - protein, 347 aa, Homo sapiens
  Payload ID: 15673
  Gene Symbol: SH3GL3
  Gene Name: SH3-domain GRB2-like 3
  Uniprot ID: Q99963
  ENSP ID: ENSP00000391372
MSVAGLKKQFHKASQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 78689 - protein, 65 aa, Homo sapiens
  Payload ID: 15673
  Gene Symbol: SH3GL3
  Gene Name: SH3-domain GRB2-like 3
  ENSP ID: ENSP00000456249
MSVAGLKKQFHKASQLFSEKISGAEGTKLDDEFLDMERKIDVTNKVVAEILSKTTEYLQPNPELS

SEQ ID NO: 78690 - protein, 386 aa, Homo sapiens
  Payload ID: 15674
  Gene Symbol: SH3GLB1
  Gene Name: SH3-domain GRB2-like endophilin B1
  Uniprot ID: Q9Y371
  ENSP ID: ENSP00000418744
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSQLNSARLEGDNIMIWAEEVTKSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 78691 - protein, 265 aa, Homo sapiens
  Payload ID: 15674
  Gene Symbol: SH3GLB1
  Gene Name: SH3-domain GRB2-like endophilin B1
  Uniprot ID: Q9Y371
  ENSP ID: ENSP00000441355
MIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 78692 - protein, 365 aa, Homo sapiens
  Payload ID: 15674
  Gene Symbol: SH3GLB1
  Gene Name: SH3-domain GRB2-like endophilin B1
  Uniprot ID: Q9Y371
  ENSP ID: ENSP00000473267
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 78693 - protein, 394 aa, Homo sapiens
  Payload ID: 15674
  Gene Symbol: SH3GLB1
  Gene Name: SH3-domain GRB2-like endophilin B1
  ENSP ID: ENSP00000479919
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSQLNSARLEGDNIMVNFSYMLNFLHVKWLKSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 78694 - protein, 404 aa, Homo sapiens
  Payload ID: 15675
  Gene Symbol: SH3GLB2
  Gene Name: SH3-domain GRB2-like endophilin B2
  Uniprot ID: Q9NR46
  ENSP ID: ENSP00000361634
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATCEGDTVPDFQETRPRNYILSASASALWNDEVDKAEQELRVAQTEFDRQAEVTRLLLEGISSTHVNHLRCLHEFVKSQTTYYAQCYRHMLDLQKQLGSSQGAIFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 78695 - protein, 395 aa, Homo sapiens
  Payload ID: 15675
  Gene Symbol: SH3GLB2
  Gene Name: SH3-domain GRB2-like endophilin B2
  Uniprot ID: Q9NR46
  ENSP ID: ENSP00000361640
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATTVPDFQETRPRNYILSASASALWNDEVDKAEQELRVAQTEFDRQAEVTRLLLEGISSTHVNHLRCLHEFVKSQTTYYAQCYRHMLDLQKQLGRFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 78696 - protein, 395 aa, Homo sapiens; identical to SEQ ID NO: 78695
  Payload ID: 15675
  Gene Symbol: SH3GLB2
  Gene Name: SH3-domain GRB2-like endophilin B2
  Uniprot ID: Q9NR46
  ENSP ID: ENSP00000361645

SEQ ID NO: 78697 - protein, 374 aa, Homo sapiens
  Payload ID: 15675
  Gene Symbol: SH3GLB2
  Gene Name: SH3-domain GRB2-like endophilin B2
  ENSP ID: ENSP00000388282
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATLWNDEVDKAEQELRVAQTEFDRQAEVTRLLLEGISSTHVNHLRCLHEFVKSQTTYYAQCYRHMLDLQKQLGRFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 78698 - protein, 24 aa, Homo sapiens
  Payload ID: 15675
  Gene Symbol: SH3GLB2
  Gene Name: SH3-domain GRB2-like endophilin B2
  ENSP ID: ENSP00000396761
MDFNMKKLASDAGIFFTRAVQGRH

SEQ ID NO: 78699 - protein, 127 aa, Homo sapiens
  Payload ID: 15675
  Gene Symbol: SH3GLB2
  Gene Name: SH3-domain GRB2-like endophilin B2
  ENSP ID: ENSP00000400951
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYDRILLCHPDWSAVVQS

SEQ ID NO: 78700 - protein, 400 aa, Homo sapiens
  Payload ID: 15675
  Gene Symbol: SH3GLB2
  Gene Name: SH3-domain GRB2-like endophilin B2
  ENSP ID: ENSP00000402566
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATTVPDFQETRPRNYILSASASALWNDEVDKAEQELRVAQTEFDRQAEVTRLLLEGISSTHVNHLRCLHEFVKSQTTYYAQCYRHMLDLQKQLGSSQGAIFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 78701 - protein, 59 aa, Homo sapiens
  Payload ID: 15675
  Gene Symbol: SH3GLB2
  Gene Name: SH3-domain GRB2-like endophilin B2
  ENSP ID: ENSP00000403228
VEEFLYEKLDRKVPSRVTNGELLAQYMADAASELGPTTPYGSCCVTQTGVQWCNHSLLL

SEQ ID NO: 78702 - protein, 553 aa, Homo sapiens
  Payload ID: 15676
  Gene Symbol: SH3KBP1
  Gene Name: SH3-domain kinase binding protein 1
  ENSP ID: ENSP00000369019
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSRPEGLPPASLLPFPAHGAKGKTTFEGTILYRAAPGKTEGHRRYYSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRYCCALTSGAGVGWLWKEHRRGTDCHRPWEEGRGEGGAQASLLHPPAKLSEDTGHFCPCSCTQAGVSVRLRGAVWVS

SEQ ID NO: 78703 - protein, 628 aa, Homo sapiens
  Payload ID: 15676
  Gene Symbol: SH3KBP1
  Gene Name: SH3-domain kinase binding protein 1
  Uniprot ID: Q96B97
  ENSP ID: ENSP00000369020
MEVSAAKAPSAADLSEIEIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 78704 - protein, 427 aa, Homo sapiens
  Payload ID: 15676
  Gene Symbol: SH3KBP1
  Gene Name: SH3-domain kinase binding protein 1
  Uniprot ID: Q96B97
  ENSP ID: ENSP00000369039
MGEETIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 78705 - protein, 645 aa, Homo sapiens
  Payload ID: 15676
  Gene Symbol: SH3KBP1
  Gene Name: SH3-domain kinase binding protein 1
  ENSP ID: ENSP00000369049
LTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSRPEGLPPASLLPFPAHGAKGKTTFEGTILYRAAPGKTEGHRRYYSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 78706 - protein, 665 aa, Homo sapiens
  Payload ID: 15676
  Gene Symbol: SH3KBP1
  Gene Name: SH3-domain kinase binding protein 1
  Uniprot ID: Q96B97
  ENSP ID: ENSP00000380921
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 78707 - protein, 208 aa, Homo sapiens
  Payload ID: 15676
  Gene Symbol: SH3KBP1
  Gene Name: SH3-domain kinase binding protein 1
  ENSP ID: ENSP00000388766
MEIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTE

SEQ ID NO: 78708 - protein, 149 aa, Homo sapiens
  Payload ID: 15676
  Gene Symbol: SH3KBP1
  Gene Name: SH3-domain kinase binding protein 1
  ENSP ID: ENSP00000409292
MERSERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVE

SEQ ID NO: 78709 - protein, 707 aa, Homo sapiens
  Payload ID: 15677
  Gene Symbol: SHKBP1
  Gene Name: SH3KBP1 binding protein 1
  Uniprot ID: Q8TBC3
  ENSP ID: ENSP00000291842
MAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78710 - protein, 37 aa, Homo sapiens
  Payload ID: 15677
  Gene Symbol: SHKBP1
  Gene Name: SH3KBP1 binding protein 1
  ENSP ID: ENSP00000468885
MRPEQSSSTGTLQSSPPSSTSCAPKSWIPAFSVHPHT

SEQ ID NO: 78711 - protein, 131 aa, Homo sapiens
  Payload ID: 15677
  Gene Symbol: SHKBP1
  Gene Name: SH3KBP1 binding protein 1
  ENSP ID: ENSP00000469014
MRPEQSSSTGTLQSSPPSSTSCAPKSWIPVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAV

SEQ ID NO: 78712 - protein, 250 aa, Homo sapiens
  Payload ID: 15677
  Gene Symbol: SHKBP1
  Gene Name: SH3KBP1 binding protein 1
  ENSP ID: ENSP00000469713
  MOD_RES (1)..(1): Any amino acid
XELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78713 - protein, 141 aa, Homo sapiens
  Payload ID: 15677
  Gene Symbol: SHKBP1
  Gene Name: SH3KBP1 binding protein 1
  ENSP ID: ENSP00000469878
MAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVLLLQFVACSFERSWIDLLVETSSSMVTCRHQCSQ

SEQ ID NO: 78714 - protein, 164 aa, Homo sapiens
  Payload ID: 15677
  Gene Symbol: SHKBP1
  Gene Name: SH3KBP1 binding protein 1
  ENSP ID: ENSP00000470505
  MOD_RES (1)..(1): Any amino acid
XQMGMAAAVLAMTLAPTVSGTTSKCSSRRWCPVPASSSCVSHLLGSAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78715 - protein, 102 aa, Homo sapiens
  Payload ID: 15677
  Gene Symbol: SHKBP1
  Gene Name: SH3KBP1 binding protein 1
  ENSP ID: ENSP00000470514
MAAAATAAEGVPSRGPPGEVIHLNVGGKRFSTSRQTLTWIPDSFFSSLLSGRISTLKDETGAIFIDRDPTVFAPILNFLRTKELDPRLAWKKGRESLTVFSP

SEQ ID NO: 78716 - protein, 299 aa, Homo sapiens
  Payload ID: 15677
  Gene Symbol: SHKBP1
  Gene Name: SH3KBP1 binding protein 1
  ENSP ID: ENSP00000470517
  MOD_RES (1)..(1): Any amino acid
XGSIYYVDVQKFPLRMKDNDLLVSELYRDPAEDGVTALSVYLTPKTICADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPP

SEQ ID NO: 78717 - protein, 262 aa, Homo sapiens
  Payload ID: 15677
  Gene Symbol: SHKBP1
  Gene Name: SH3KBP1 binding protein 1
  ENSP ID: ENSP00000471173
KFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78718 - protein, 175 aa, Homo sapiens
  Payload ID: 15677
  Gene Symbol: SHKBP1
  Gene Name: SH3KBP1 binding protein 1
  ENSP ID: ENSP00000471296
  MOD_RES (1)..(1): Any amino acid
XDSGNWIEIAYGTSSGGVRVIVQHPETVGSGPQLFQTFTVHRSPVTKIMLSEKHLISAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78719 - protein, 610 aa, Homo sapiens
  Payload ID: 15677
  Gene Symbol: SHKBP1
  Gene Name: SH3KBP1 binding protein 1
  ENSP ID: ENSP00000471406
  MOD_RES (1)..(1): Any amino acid
XAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78720 - protein, 277 aa, Homo sapiens
  Payload ID: 15677
  Gene Symbol: SHKBP1
  Gene Name: SH3KBP1 binding protein 1
  ENSP ID: ENSP00000471408
RSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78721 - protein, 143 aa, Homo sapiens
  Payload ID: 15677
  Gene Symbol: SHKBP1
  Gene Name: SH3KBP1 binding protein 1
  ENSP ID: ENSP00000471845
  MOD_RES (1)..(1): Any amino acid
XTSKCSSRRWCPVPASSSCVSHLLGSGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78722 - protein, 129 aa, Homo sapiens
  Payload ID: 15677
  Gene Symbol: SHKBP1
  Gene Name: SH3KBP1 binding protein 1
  ENSP ID: ENSP00000472222
  MOD_RES (1)..(1): Any amino acid
XGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRWPDGARADGTAGTL

SEQ ID NO: 78723 - protein, 682 aa, Homo sapiens
  Payload ID: 15677
  Gene Symbol: SHKBP1
  Gene Name: SH3KBP1 binding protein 1
  ENSP ID: ENSP00000472711
MAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 78724 - protein, 88 aa, Homo sapiens
  Payload ID: 15677
  Gene Symbol: SHKBP1
  Gene Name: SH3KBP1 binding protein 1
  ENSP ID: ENSP00000472813
MAAAATAAEGVPSRGPPGEVIHLNVGGKRFSTSRQTLTWIPDSFFSSLLSGRISTLKDETGAIFIDRDPTVFAPILNFLRTKELDPRP

SEQ ID NO: 78725 - protein, 151 aa, Homo sapiens
  Payload ID: 15678
  Gene Symbol: SPRN
  Gene Name: shadow of prion protein homolog (zebrafish)
  Uniprot ID: Q5BIV9
  ENSP ID: ENSP00000433712
MNWAPATCWALLLAAAFLCDSGAAKGGRGGARGSARGGVRGGARGASRVRVRPAQRYGAPGSSLRVAAAGAAAGAAAGAAAGLAAGSGWRRAAGPGERGLEDEEDGVPGGNGTGPGIYSYRAWTSGAGPTRGPRLCLVLGGALGALGLLRP

SEQ ID NO: 78726 - protein, 326 aa, Homo sapiens
  Payload ID: 15679
  Gene Symbol: SHARPIN
  Gene Name: SHANK-associated RH domain interactor
  Uniprot ID: Q9H0F6
  ENSP ID: ENSP00000352551
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPAQLVLSFLHLHQCPRPPWL

SEQ ID NO: 78727 - protein, 387 aa, Homo sapiens
  Payload ID: 15679
  Gene Symbol: SHARPIN
  Gene Name: SHANK-associated RH domain interactor
  Uniprot ID: Q9H0F6
  ENSP ID: ENSP00000381698
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPATGPSPQHPQKMDGELGRLFPPSLGLPPGPQPAASSLPSPLQPSWSCPSCTFINAPDRPGCEMCSTQRPCTWDPLAAAST

SEQ ID NO: 78728 - protein, 95 aa, Homo sapiens
  Payload ID: 15679
  Gene Symbol: SHARPIN
  Gene Name: SHANK-associated RH domain interactor
  ENSP ID: ENSP00000432355
DPAFLYLLSAPREAPATGPSPQHPQKMDGELGRLFPPSLGLPPGPQPAASSLPSPLQPSWSCPSCTFINAPDRPGCEMCSTQRPCTWDPLAAAST

SEQ ID NO: 78729 - protein, 630 aa, Homo sapiens
  Payload ID: 15680
  Gene Symbol: SHC4
  Gene Name: SHC (Src homology 2 domain containing) family, member 4
  Uniprot ID: Q6S5L8
  ENSP ID: ENSP00000329668
MRERGQDSLAGLVLYVGLFGHPGMLHRAKYSRFRNESITSLDEGSSGGSVGNKGSPQPPHPALAPHLPTEDATLPSQESPTPLCTLIPRMASMKLANPATLLSLKNFCLGTKEVPRLKLQESRDPGSSGPSSPETSLSRSGTAPPPQQDLVGHRATALTPDSCPLPGPGEPTLRSRQDRHFLQHLLGMGMNYCVRYMGCVEVLQSMRSLDFGMRTQVTREAISRLCEAVPGANGAIKKRKPPVKFLSTVLGKSNLQFSGMNIKLTISTCSLTLMNLDNQQIIANHHMQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 78730 - protein, 387 aa, Homo sapiens
  Payload ID: 15680
  Gene Symbol: SHC4
  Gene Name: SHC (Src homology 2 domain containing) family, member 4
  Uniprot ID: Q6S5L8
  ENSP ID: ENSP00000379786
MLPALEHWIPKFFSFRTRTGSPLSLACRQPIVGPCDHIIANHHMQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 78731 - protein, 344 aa, Homo sapiens
  Payload ID: 15680
  Gene Symbol: SHC4
  Gene Name: SHC (Src homology 2 domain containing) family, member 4
  ENSP ID: ENSP00000443300
MQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 78732 - protein, 144 aa, Homo sapiens
  Payload ID: 15680
  Gene Symbol: SHC4
  Gene Name: SHC (Src homology 2 domain containing) family, member 4
  ENSP ID: ENSP00000453344
MQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLVMSIQEGCSPSEIPHY

SEQ ID NO: 78733 - protein, 128 aa, Homo sapiens
  Payload ID: 15680
  Gene Symbol: SHC4
  Gene Name: SHC (Src homology 2 domain containing) family, member 4
  ENSP ID: ENSP00000453397
MQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYL

SEQ ID NO: 78734 - protein, 583 aa, Homo sapiens
  Payload ID: 15681
  Gene Symbol: SHC1
  Gene Name: SHC (Src homology 2 domain containing) transforming protein 1
  Uniprot ID: P29353
  ENSP ID: ENSP00000357430
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 78735 - protein, 354 aa, Homo sapiens
  Payload ID: 15681
  Gene Symbol: SHC1
  Gene Name: SHC (Src homology 2 domain containing) transforming protein 1
  ENSP ID: ENSP00000357434
MPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 78736 - protein, 473 aa, Homo sapiens
  Payload ID: 15681
  Gene Symbol: SHC1
  Gene Name: SHC (Src homology 2 domain containing) transforming protein 1
  Uniprot ID: P29353
  ENSP ID: ENSP00000357435
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 78737 - protein, 474 aa, Homo sapiens
  Payload ID: 15681
  Gene Symbol: SHC1
  Gene Name: SHC (Src homology 2 domain containing) transforming protein 1
  Uniprot ID: P29353
  ENSP ID: ENSP00000357438
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 78738 - protein, 137 aa, Homo sapiens
  Payload ID: 15681
  Gene Symbol: SHC1
  Gene Name: SHC (Src homology 2 domain containing) transforming protein 1
  ENSP ID: ENSP00000396162
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAAD

SEQ ID NO: 78739 - protein, 297 aa, Homo sapiens
  Payload ID: 15681
  Gene Symbol: SHC1
  Gene Name: SHC (Src homology 2 domain containing) transforming protein 1
  ENSP ID: ENSP00000396333
  MOD_RES (1)..(1): Any amino acid
XDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVRWGFAMLPKLFLNSRAQVIRLPRPPRVLGLQARTTMPSLHIFFCTVYTLLRHANFLQVKKGVYSSQLHSFRADVAFAFSHFTDLSIPTTVSF

SEQ ID NO: 78740 - protein, 200 aa, Homo sapiens
  Payload ID: 15681
  Gene Symbol: SHC1
  Gene Name: SHC (Src homology 2 domain containing) transforming protein 1
  ENSP ID: ENSP00000398441
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQDTAEYVAYVAKDPVNQRACHILECPEGLAQDVISTIGQAFELRFKQYLRNPPKLVTPHDR

SEQ ID NO: 78741 - protein, 129 aa, Homo sapiens
  Payload ID: 15681
  Gene Symbol: SHC1
  Gene Name: SHC (Src homology 2 domain containing) transforming protein 1
  ENSP ID: ENSP00000398864
MPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEP

SEQ ID NO: 78742 - protein, 584 aa, Homo sapiens
  Payload ID: 15681
  Gene Symbol: SHC1
  Gene Name: SHC (Src homology 2 domain containing) transforming protein 1
  Uniprot ID: P29353
  ENSP ID: ENSP00000401303
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 78743 - protein, 200 aa, Homo sapiens
  Payload ID: 15681
  Gene Symbol: SHC1
  Gene Name: SHC (Src homology 2 domain containing) transforming protein 1
  ENSP ID: ENSP00000404908
MPITLTVSTSSLNLMAADCKQDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPP

SEQ ID NO: 78744 - protein, 582 aa, Homo sapiens
  Payload ID: 15682
  Gene Symbol: SHC2
  Gene Name: SHC (Src homology 2 domain containing) transforming protein 2
  Uniprot ID: P98077
  ENSP ID: ENSP00000264554
MTQGPGGRAPPAPPAPPEPEAPTTFCALLPRMPQWKFAAPGGFLGRGPAAARAAGASGGADPQPEPAGPGGVPALAAAVLGACEPRCAAPCPLPALSRCRGAGSRGSRGGRGAAGSGDAAAAAEWIRKGSFIHKPAHGWLHPDARVLGPGVSYVVRYMGCIEVLRSMRSLDFNTRTQVTREAINRLHEAVPGVRGSWKKKAPNKALASVLGKSNLRFAGMSISIHISTDGLSLSVPATRQVIANHHMPSISFASGGDTDMTDYVAYVAKDPINQRACHILECCEGLAQSIISTVGQAFELRFKQYLHSPPKVALPPERLAGPEESAWGDEEDSLEHNYYNSIPGKEPPLGGLVDSRLALTQPCALTALDQGPSPSLRDACSLPWDVGSTGTAPPGDGYVQADARGPPDHEEHLYVNTQGLDAPEPEDSPKKDLFDMRPFEDALKLHECSVAAGVTAAPLPLEDQWPSPPTRRAPVAPTEEQLRQEPWYHGRMSRRAAERMLRADGDFLVRDSVTNPGQYVLTGMHAGQPKHLLLVDPEGVVRTKDVLFESISHLIDHHLQNGQPIVAAESELHLRGVVSREP

SEQ ID NO: 78745 - protein, 138 aa, Homo sapiens
  Payload ID: 15682
  Gene Symbol: SHC2
  Gene Name: SHC (Src homology 2 domain containing) transforming protein 2
  ENSP ID: ENSP00000465764
  MOD_RES (1)..(1): Any amino acid
XGPGTEHHQHRGPSFRAALQAVPAQPAQGGAAPRKAGRAGGVGLGGRGGLFGAQLLQQHPGEGAAAGRASGLQAGPDTALRPHGPRPGPISFSKRCLQPAMGRGVHRYRTSGPAPLPAGPLWPPRRNSCVRSPGTTAG

SEQ ID NO: 78746 - protein, 69 aa, Homo sapiens
  Payload ID: 15682
  Gene Symbol: SHC2
  Gene Name: SHC (Src homology 2 domain containing) transforming protein 2
  ENSP ID: ENSP00000466869
  MOD_RES (1)..(1): Any amino acid
XDARVLGPGVSYVVRYMGCIEVLRSMRSLDFNTRTQVTSSCHHSGCRQDLDTDPASGSGPPARCSNPHI

SEQ ID NO: 78747 - protein, 105 aa, Homo sapiens
  Payload ID: 15683
  Gene Symbol: SHC3
  Gene Name: SHC (Src homology 2 domain containing) transforming protein 3
  ENSP ID: ENSP00000364991
MKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTRSNSY

SEQ ID NO: 78748 - protein, 594 aa, Homo sapiens
  Payload ID: 15683
  Gene Symbol: SHC3
  Gene Name: SHC (Src homology 2 domain containing) transforming protein 3
  Uniprot ID: Q92529
  ENSP ID: ENSP00000364995
MLPRTKYNRFRNDSVTSVDDLLHSLSVSGGGGKVSAARATPAAAPYLVSGEALRKAPDDGPGSLGHLLHKVSHLKLSSSGLRGLSSAARERAGARLSGSCSAPSLAAPDGSAPSAPRAPAMSAARKGRPGDEPLPRPPRGAPHASDQVLGPGVTYVVKYLGCIEVLRSMRSLDFSTRTQITREAISRVCEAVPGAKGAFKKRKPPSKMLSSILGKSNLQFAGMSISLTISTASLNLRTPDSKQIIANHHMRSISFASGGDPDTTDYVAYVAKDPVNRRACHILECCDGLAQDVIGSIGQAFELRFKQYLQCPTKIPALHDRMQSLDEPWTEEEGDGSDHPYYNSIPSKMPPPGGFLDTRLKPRPHAPDTAQFAGKEQTYYQGRHLGDTFGEDWQQTPLRQGSSDIYSTPEGKLHVAPTGEAPTYVNTQQIPPQAWPAAVSSAESSPRKDLFDMKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTIRTKDRVFDSISHLINHHLESSLPIVSAGSELCLQQPVERKQ

SEQ ID NO: 78749 - protein, 672 aa, Homo sapiens
  Payload ID: 15684
  Gene Symbol: SHCBP1
  Gene Name: SHC SH2-domain binding protein 1
  Uniprot ID: Q8NEM2
  ENSP ID: ENSP00000306473
MADGSLTGGGLEAAAMAPERMGWAVEQELASLEKGLFQDEDSCSDCSYRDKPGSSLQSFMPEGKTFFPEIFQTNQLLFYERFRAYQDYILADCKASEVQEFTAEFLEKVLEPSGWRAVWHTNVFKVLVEITDVDFAALKAVVRLAEPYLCDSQVSTFTMECMKELLDLKEHRLPLQELWVVFDDSGVFDQTALAIEHVRFFYQNIWRSWDEEEEDEYDYFVRCVEPRLRLHYDILEDRVPSGLIVDYHNLLSQCEESYRKFLNLRSSLSNCNSDSEQENISMVEGLKLYSEMEQLKQKLKLIENPLLRYVFGYQKNSNIQAKGVRSSGQKITHVVSSTMMAGLLRSLLTDRLCQEPGEEEREIQFHSDPLSAINACFEGDTVIVCPGHYVVHGTFSIADSIELEGYGLPDDIVIEKRGKGDTFVDCTGADIKISGIKFVQHDAVEGILIVHRGKTTLENCVLQCETTGVTVRTSAEFLMKNSDLYGAKGAGIEIYPGSQCTLSDNGIHHCKEGILIKDFLDEHYDIPKISMVNNIIHNNEGYGVVLVKPTIFSDLQENAEDGTEENKALKIQTSGEPDVAERVDLEELIECATGKMELCARTDPSEQVEGNCEIVNELIAASTQKGQIKKKRLSELGITQADDNLMSQEMFVGIVGNQFKWNGKGSFGTFLF

SEQ ID NO: 78750 - protein, 155 aa, Homo sapiens
  Payload ID: 15684
  Gene Symbol: SHCBP1
  Gene Name: SHC SH2-domain binding protein 1
  ENSP ID: ENSP00000460840
  MOD_RES (1)..(1): Any amino acid
XDSGVFDQTALAIEHVRFFYQNIWRSWDEEEEDEYDYFVRCVEPRLRLYVFGYQKNSNIQAKGVRSSGQKITHVVSSTMMAGLLRSLLTDRLCQEPGEEEREIQFHSDPLSAINACFEGDTVIVCPGHYVVHGTFSIADSIELEGYGLPDDIVIE

SEQ ID NO: 78751 - protein, 653 aa, Homo sapiens
  Payload ID: 15685
  Gene Symbol: SHCBP1L
  Gene Name: SHC SH2-domain binding protein 1-like
  Uniprot ID: Q9BZQ2
  ENSP ID: ENSP00000356518
MASGSKASVPADSFRTISPDRRGEKSASAVSGDTAAATTLKGTAIPVRSVVASPRPVKGKAGRETARLRLQRLPAAQAEDTGEAAAAAAEEPLLPVPEDEEEAQPLPPVCVSRMRGMWRDEKVSLYCDEVLQDCKAEDADEVMGKYLSEKLKLKDKWLGVWKTNPSVFFVKYEEASIPFVGILVEVTCEPYQDSSSRFKVTVSVAEPFSSNIANIPRDLVDEILEELEHSVPLLEVYPVEGQDTDIHVIALALEVVRFFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 78752 - protein, 724 aa, Homo sapiens
  Payload ID: 15685
  Gene Symbol: SHCBP1L
  Gene Name: SHC SH2-domain binding protein 1-like
  ENSP ID: ENSP00000397308
MRPQDPALYPQAPHPLALGRASHPSQSRNTPPAGRPRAAARCGPERRAPIGQSGRGREKWPTAASALGLLRRWRRSKASVPADSFRTISPDRRGEKSASAVSGDTAAATTLKGTAIPVRSVVASPRPVKGKAGRETARLRLQRLPAAQAEDTGEAAAAAAEEPLLPVPEDEEEAQPLPPVCVSRMRGMWRDEKVSLYCDEVLQDCKAEDADEVMGKYLSEKLKLKDKWLGVWKTNPSVFFVKYEEASIPFVGILVEVTCEPYQDSSSRFKVTVSVAEPFSSNIANIPRDLVDEILEELEHSVPLLEVYPVEGQDTDIHVIALALEVVRFFYDFLWRDWDDEESCENYTALIEERINLWCDIQDGTIPGPIAQRFKKTLEKYKNKRVELIEYQSNIKEDPSAAEAVECWKKYYEIVMLCGLLKMWEDLRLRVHGPFFPRILRRRKGKREFGKTITHIVAKMMTTEMIKDLSSDTLLQQHGDLDLALDNCYSGDTVIIFPGEYQAANLALLTDDIIIKGVGKREEIMITSEPSRDSFVVSKADNVKLMHLSLIQQGTVDGIVVVESGHMTLENCILKCEGTGVCVLTGAALTITDSEITGAQGAGVELYPGSIAILERNEIHHCNNLRTSNSSKSTLGGVNMKVLPAPKLKMTNNHIYSNKGYGVSILQPMEQFFIVAEEALNKRASSGDKKDDKMLFKVMQNLNLEMNNNKIEANVKGDIRIVTS

SEQ ID NO: 78753 - protein, 295 aa, Homo sapiens
  Payload ID: 15686
  Gene Symbol: SHISA2
  Gene Name: shisa family member 2
  Uniprot ID: Q6UWI4
  ENSP ID: ENSP00000313079
MWGARRSSVSSSWNAASLLQLLLAALLAAGARASGEYCHGWLDAQGVWRIGFQCPERFDGGDATICCGSCALRYCCSSAEARLDQGGCDNDRQQGAGEPGRADKDGPDGSAVPIYVPFLIVGSVFVAFIILGSLVAACCCRCLRPKQDPQQSRAPGGNRLMETIPMIPSASTSRGSSSRQSSTAASSSSSANSGARAPPTRSQTNCCLPEGTMNNVYVNMPTNFSVLNCQQATQIVPHQGQYLHPPYVGYTVQHDSVPMTAVPPFMDGLQPGYRQIQSPFPHTNSEQKMYPAVTV

SEQ ID NO: 78754 - protein, 238 aa, Homo sapiens
  Payload ID: 15687
  Gene Symbol: SHISA3
  Gene Name: shisa family member 3
  Uniprot ID: A0PJX4
  ENSP ID: ENSP00000326445
MRALLALCLLLGWLRWGPAGAQQSGEYCHGWVDVQGNYHEGFQCPEDFDTLDATICCGSCALRYCCAAADARLEQGGCTNDRRELEHPGITAQPVYVPFLIVGSIFIAFIILGSVVAIYCCTCLRPKEPSQQPIRFSLRSYQTETLPMILTSTSPRAPSRQSSTATSSSSTGGSIRRFSFARAEPGCLVPSPPPPYTTSHSIHLAQPSGFLVSPQYFAYPLQQEPPLPGKSCPDFSSS

SEQ ID NO: 78755 - protein, 197 aa, Homo sapiens
  Payload ID: 15688
  Gene Symbol: SHISA4
  Gene Name: shisa family member 4
  Uniprot ID: Q96DD7
  ENSP ID: ENSP00000355064
MPPAGLRRAAPLTAIALLVLGAPLVLAGEDCLWYLDRNGSWHPGFNCEFFTFCCGTCYHRYCCRDLTLLITERQQKHCLAFSPKTIAGIASAVILFVAVVATTICCFLCSCCYLYRRRQQLQSPFEGQEIPMTGIPVQPVYPYPQDPKAGPAPPQPGFIYPPSGPAPQYPLYPAGPPVYNPAAPPPYMPPQPSYPGA

SEQ ID NO: 78756 - protein, 240 aa, Homo sapiens
  Payload ID: 15689
  Gene Symbol: SHISA5
  Gene Name: shisa family member 5
  Uniprot ID: Q8N114
  ENSP ID: ENSP00000296444
MTAPVPAPRILLPLLLLLLLTPPPGARGEVCMASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 78757 - protein, 137 aa, Homo sapiens
  Payload ID: 15689
  Gene Symbol: SHISA5
  Gene Name: shisa family member 5
  Uniprot ID: Q8N114
  ENSP ID: ENSP00000390388
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 78758 - protein, 233 aa, Homo sapiens
  Payload ID: 15689
  Gene Symbol: SHISA5
  Gene Name: shisa family member 5
  Uniprot ID: Q8N114
  ENSP ID: ENSP00000395373
MTAPVPAPRILLPLLLLLLLTPPPGARGEVCMASRGLSLFPESCPDFCCGTCDDQYCCSDVLKKFVWSEESVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 78759 - protein, 61 aa, Homo sapiens
  Payload ID: 15689
  Gene Symbol: SHISA5
  Gene Name: shisa family member 5
  ENSP ID: ENSP00000400498
MTAPVPAPRILLPLLLLLLLTPPPGGLQMVPLPWSPVAQAGLKLLEGTDISWTPAAGPARG

SEQ ID NO: 78760 - protein, 47 aa, Homo sapiens
  Payload ID: 15689
  Gene Symbol: SHISA5
  Gene Name: shisa family member 5
  ENSP ID: ENSP00000407330
  MOD_RES (1)..(1): Any amino acid
XLLLLLTPPPGGEPGVGAARPALGPGRHFPALPLQRAGQHQPHYAPH

SEQ ID NO: 78761 - protein, 209 aa, Homo sapiens
  Payload ID: 15689
  Gene Symbol: SHISA5
  Gene Name: shisa family member 5
  Uniprot ID: Q8N114
  ENSP ID: ENSP00000407957
MASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 78762 - protein, 209 aa, Homo sapiens; identical to SEQ ID NO: 78761
  Payload ID: 15689
  Gene Symbol: SHISA5
  Gene Name: shisa family member 5
  Uniprot ID: Q8N114
  ENSP ID: ENSP00000408223

SEQ ID NO: 78763 - protein, 112 aa, Homo sapiens
  Payload ID: 15689
  Gene Symbol: SHISA5
  Gene Name: shisa family member 5
  ENSP ID: ENSP00000412509
MASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPR

SEQ ID NO: 78764 - protein, 123 aa, Homo sapiens
  Payload ID: 15689
  Gene Symbol: SHISA5
  Gene Name: shisa family member 5
  ENSP ID: ENSP00000412811
MTAPVPAPRILLPLLLLLLLTPPPGARGEVCMASRGLSLFPESCPDFCCGTCDDQYCCSDVLKKFVWSEERCAVPEASVPASVEPVEQLGSALRFRPGYNDPMSGFELGQQGGDSAEQAPRGA

SEQ ID NO: 78765 - protein, 44 aa, Homo sapiens
  Payload ID: 15689
  Gene Symbol: SHISA5
  Gene Name: shisa family member 5
  ENSP ID: ENSP00000415097
MTAPVPAPRILLPLLLLLLLTPPPGALAQRLRLGCEDLAAYGFT

SEQ ID NO: 78766 - protein, 170 aa, Homo sapiens [sequence omitted]

SEQ ID NO: 78767 - protein, 209 aa, Homo sapiens; identical to SEQ ID NO: 78761
  Payload ID: 15689
  Gene Symbol: SHISA5
  Gene Name: shisa family member 5
  Uniprot ID: Q8N114
  ENSP ID: ENSP00000484992

SEQ ID NO: 78768 - protein, 500 aa, Homo sapiens
  Payload ID: 15690
  Gene Symbol: SHISA6
  Gene Name: shisa family member 6
  Uniprot ID: Q6ZSJ9
  ENSP ID: ENSP00000387157
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 78769 - protein, 532 aa, Homo sapiens
  Payload ID: 15690
  Gene Symbol: SHISA6
  Gene Name: shisa family member 6
  Uniprot ID: Q6ZSJ9
  ENSP ID: ENSP00000388659
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPGHYGKDAYRSGGPDLHNFISSGFVTLGRGHTKEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 78770 - protein, 551 aa, Homo sapiens
  Payload ID: 15690
  Gene Symbol: SHISA6
  Gene Name: shisa family member 6
  Uniprot ID: Q6ZSJ9
  ENSP ID: ENSP00000390084
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPGHYGKDAYRSGGPDLHNFISSGFVTLGRGHTKGDHQYNHPILSSVTQIPPHEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 78771 - protein, 134 aa, Homo sapiens
  Payload ID: 15690
  Gene Symbol: SHISA6
  Gene Name: shisa family member 6
  ENSP ID: ENSP00000477331
  MOD_RES (1)..(1): Any amino acid
XTNFTVYITCGVIAFVIVAGVFAKVSYDKAHRPPREMNIHRALADILRQQGPIPIAHCERETISAIDTSPKENTPVRSSSKNHYTPVRTAKQTPGHYGKDAYRSGGPDLHNFISSGFVTLGRGHTKGTVETIFY

SEQ ID NO: 78772 - protein, 538 aa, Homo sapiens
  Payload ID: 15691
  Gene Symbol: SHISA7
  Gene Name: shisa family member 7
  Uniprot ID: A6NL88
  ENSP ID: ENSP00000365503
MPALLLLVLLASSAGQARARPSNATSAEPAGPLPALLAHLRRLTGALTGGGGAASPGANGTRTGPAGGAGAAARAPPPAELCHGYYDVMGQYDATFNCSTGSYRFCCGTCHYRFCCEHRHMRLAQASCSNYDTPRWATTPPPLAGGAGGAGGAGGGPGPGQAGWLEGGRTGGAGGRGGEGPGGSTAYVVCGVISFALAVGVGAKVAFSKASRAPRAHRDINVPRALVDILRHQAGPGTRPDRARSSSLTPGIGGPDSMPPRTPKNLYNTVKTPNLDWRALPPPSPSLHYSTLSCSRSFHNLSHLPPSYEAAVKSELNRYSSLKRLAEKDLDEAYLKRRPLELPRGTLPLHALRRPGTGGGYRMEAWGGPEELGLAPAPNPRRVMSQEHLLGDGGRSRYEFTLPRARLVSQEHLLLSSPEALRQSREHLLSPPRSPALPPDPTARASLAASHSNLLLGPGGPPTPLRGLPPPSSLHAHHHHALHGSPQPAWMSDAGGGGGTLARRPPFQRQGTLEQLQFIPGHHLPQHLRTASKNEVTV

SEQ ID NO: 78773 - protein, 153 aa, Homo sapiens
  Payload ID: 15691
  Gene Symbol: SHISA7
  Gene Name: shisa family member 7
  ENSP ID: ENSP00000401307
  MOD_RES (1)..(1): Any amino acid
XGGEGPGGSTAYVVCGVISFALAVGVGAKVAFSKASRAPRAHRDINVPRALVDILRHQAGPGTRPDRARSSSLTPGIGGPDSMPPRTPKNLYNTVKTPNLATCTSTSTAPSTTPPHWTGEPCRRPAPPCTTPRCPALGPSTTSRICPRPTRLP

SEQ ID NO: 78774 - protein, 162 aa, Homo sapiens
  Payload ID: 15692
  Gene Symbol: SHISA8
  Gene Name: shisa family member 8
  Uniprot ID: B8ZZ34
  ENSP ID: ENSP00000389964
  MOD_RES (1)..(1): Any amino acid
XSGRAGAPEAQGPAAPGTTAPEGGDRCRGYYDVMGQWDPPFNCSSGAYSFCCGTCGYRFCCHDGPRRLDQSRCSNYDTPAWVQTGRPPARARDTAAPRDPGRERSHTAVYAVCGVAALLVLAGIGARLGLERAHSPRARRTVTRALTELLKQPGPQEPLPPT

SEQ ID NO: 78775 - protein, 397 aa, Homo sapiens
  Payload ID: 15692
  Gene Symbol: SHISA8
  Gene Name: shisa family member 8
  ENSP ID: ENSP00000481203
MARAGARGLLGGRRPPGLRLALALRLALLLARPPSGRAGAPEAQGPAAPGTTAPEGGDRCRGYYDVMGQWDPPFNCSSGAYSFCCGTCGYRFCCHDGPRRLDQSRCSNYDTPAWVQTGRPPARARDTAAPRDPGRERSHTAVYAVCGVAALLVLAGIGARLGLERAHSPRARRTVTRALTELLKQPGPQEPLPPTLGPPLGGCVQVQMGDGLPRGSPHNSADKKRLNNAPRGSAAPGPPRGPRLQGGGSLTLQPDYAKYATFKAAALKAAEAAPRDFCQRFPALEPSPRQPPARAPRPSPDLPAPLDACPWAPPVYAPPAAPGPYAAWTSSRPARPAPLSHPTARAFQVPRRPGHAARRQFSVKMPETFNPQLPGLYGSAGRGSRYLRTNSKTEVTV

SEQ ID NO: 78776 - protein, 221 aa, Homo sapiens
  Payload ID: 15693
  Gene Symbol: SHISA9
  Gene Name: shisa family member 9
  Uniprot ID: B4DS77
  ENSP ID: ENSP00000395245
MRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRLYDNLLFMEAQISFQEDEPAPGEWSVGLQTWTV

SEQ ID NO: 78777 - protein, 424 aa, Homo sapiens
  Payload ID: 15693
  Gene Symbol: SHISA9
  Gene Name: shisa family member 9
  Uniprot ID: B4DS77
  ENSP ID: ENSP00000454014
MRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRALADVMRPQGHCNTDHMERDLNIVVHVQHYENMDTRTPINNLHATQMNNAVPTSPLLQQMGHPHSYPNLGQISNPYEQQPPGKELNKYASLKAVGSSDGDWAVSTLKSPKADKVNDDFYTKRRHLAELAAKGNLPLHPVRVEDEPRAFSPEHGPAKQNGQKSRTNKMPPHPLAYTSTTNFKGWDPNEQSLRRQAYSNKGKLGTAETGSSDPLGTRPQHYPPPQPYFITNSKTEVTV

SEQ ID NO: 78778 - protein, 536 aa, Homo sapiens
  Payload ID: 15694
  Gene Symbol: SHOC2
  Gene Name: SHOC2 leucine-rich repeat scaffold protein
  Uniprot ID: Q9UQ13
  ENSP ID: ENSP00000265277
MSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 78779 - protein, 582 aa, Homo sapiens
  Payload ID: 15694
  Gene Symbol: SHOC2
  Gene Name: SHOC2 leucine-rich repeat scaffold protein
  Uniprot ID: Q9UQ13
  ENSP ID: ENSP00000358464
MSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGELCNLITLDVAHNQLEHLPKEIGNCTQITNLDLQHNELLDLPDTIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 78780 - protein, 372 aa, Homo sapiens
  Payload ID: 15694
  Gene Symbol: SHOC2
  Gene Name: SHOC2 leucine-rich repeat scaffold protein
  ENSP ID: ENSP00000408275
LDNLKKLRMLDLRHNKLREIPSVVYRLDSLTTLYLRFNRITTVEKDIKNLSKLSMLSIRENKIKQLPAEIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 78781 - protein, 571 aa, Homo sapiens
  Payload ID: 15695
  Gene Symbol: SHTN1
  Gene Name: shootin 1
  Uniprot ID: A0MZ66
  ENSP ID: ENSP00000260777
MVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 78782 - protein, 631 aa, Homo sapiens
  Payload ID: 15695
  Gene Symbol: SHTN1
  Gene Name: shootin 1
  Uniprot ID: A0MZ66
  ENSP ID: ENSP00000347532
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 78783 - protein, 498 aa, Homo sapiens
  Payload ID: 15695
  Gene Symbol: SHTN1
  Gene Name: shootin 1
  Uniprot ID: A0MZ66
  ENSP ID: ENSP00000376635
MVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQ

SEQ ID NO: 78784 - protein, 558 aa, Homo sapiens
  Payload ID: 15695
  Gene Symbol: SHTN1
  Gene Name: shootin 1
  Uniprot ID: A0MZ66
  ENSP ID: ENSP00000376636
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQ

SEQ ID NO: 78785 - protein, 456 aa, Homo sapiens
  Payload ID: 15695
  Gene Symbol: SHTN1
  Gene Name: shootin 1
  Uniprot ID: A0MZ66
  ENSP ID: ENSP00000480109
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILASQ

SEQ ID NO: 78786 - protein, 309 aa, Homo sapiens
  Payload ID: 15696
  Gene Symbol: SDR16C5
  Gene Name: short chain dehydrogenase/reductase family 16C, member 5
  Uniprot ID: Q8N3Y7
  ENSP ID: ENSP00000307607
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKSFLPLKTGLLIADYLGILHAMDGFVDQKKKL

SEQ ID NO: 78787 - protein, 265 aa, Homo sapiens
  Payload ID: 15696
  Gene Symbol: SDR16C5
  Gene Name: short chain dehydrogenase/reductase family 16C, member 5
  Uniprot ID: Q8N3Y7
  ENSP ID: ENSP00000379947
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKSFLPLKTGLLIADYLGILHAMDGFVDQKKKL

SEQ ID NO: 78788 - protein, 318 aa, Homo sapiens
  Payload ID: 15696
  Gene Symbol: SDR16C5
  Gene Name: short chain dehydrogenase/reductase family 16C, member 5
  ENSP ID: ENSP00000431010
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKRLHLAQDGSECLTEAMWDRAKDPGQAIRNSGLRSHYSLSL

SEQ ID NO: 78789 - protein, 319 aa, Homo sapiens
  Payload ID: 15697
  Gene Symbol: SDR39U1
  Gene Name: short chain dehydrogenase/reductase family 39U, member 1
  Uniprot ID: Q9NRG7
  ENSP ID: ENSP00000382322
MGWRRKRVPQRGRKAPPPQLHGNINNLYFPIRWRDRLHWDSPNPAAECQRHEVTLVSRKPGPGRITWDELAASGLPSCDAAVNLAGENILNPLRRWNETFQKEVIGSRLETTQLLAKAITKAPQPPKAWVLVTGVAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 78790 - protein, 293 aa, Homo sapiens
  Payload ID: 15697
  Gene Symbol: SDR39U1
  Gene Name: short chain dehydrogenase/reductase family 39U, member 1
  Uniprot ID: Q9NRG7
  ENSP ID: ENSP00000382327
MRVLVGGGTGFIGTALTQLLNARGHEVTLVSRKPGPGRITWDELAASGLPSCDAAVNLAGENILNPLRRWNETFQKEVIGSRLETTQLLAKAITKAPQPPKAWVLVTGVAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 78791 - protein, 211 aa, Homo sapiens
  Payload ID: 15697
  Gene Symbol: SDR39U1
  Gene Name: short chain dehydrogenase/reductase family 39U, member 1
  ENSP ID: ENSP00000446077
MSSLHRGCRAAMPPSTWPERTSSTLSEAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 78792 - protein, 185 aa, Homo sapiens
  Payload ID: 15697
  Gene Symbol: SDR39U1
  Gene Name: short chain dehydrogenase/reductase family 39U, member 1
  ENSP ID: ENSP00000450915
  MOD_RES (1)..(1): Any amino acid
XLHWDSPNPAAECQRPRSDVGLPKARARPDHVAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLL

SEQ ID NO: 78793 - protein, 128 aa, Homo sapiens
  Payload ID: 15697
  Gene Symbol: SDR39U1
  Gene Name: short chain dehydrogenase/reductase family 39U, member 1
  ENSP ID: ENSP00000450946
MGRVRKGKQKPGGAVGSFKAERTPVPSLFPALGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVF

SEQ ID NO: 78794 - protein, 66 aa, Homo sapiens
  Payload ID: 15697
  Gene Symbol: SDR39U1
  Gene Name: short chain dehydrogenase/reductase family 39U, member 1
  ENSP ID: ENSP00000451275
MGHMLLPFRLGLGGPIGSGHQFFPWIHIGDLAGILTHALEANHVHGVLNGVAPSSATNAEFAQTLG

SEQ ID NO: 78795 - protein, 95 aa, Homo sapiens
  Payload ID: 15697
  Gene Symbol: SDR39U1
  Gene Name: short chain dehydrogenase/reductase family 39U, member 1
  ENSP ID: ENSP00000451593
MGHMLLPFRLGLGGPIGSGHQFFPWIHIGDLAGILTHALEANHVHGVLNGVAPSSATNAEFAQTLGAALGRRAFIPLPSAVVQAVFGRQRAIMLL

SEQ ID NO: 78796 - protein, 126 aa, Homo sapiens
  Payload ID: 15697
  Gene Symbol: SDR39U1
  Gene Name: short chain dehydrogenase/reductase family 39U, member 1
  ENSP ID: ENSP00000451903
MGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 78797 - protein, 169 aa, Homo sapiens
  Payload ID: 15697
  Gene Symbol: SDR39U1
  Gene Name: short chain dehydrogenase/reductase family 39U, member 1
  ENSP ID: ENSP00000452076
MRTSYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLAT

SEQ ID NO: 78798 - protein, 185 aa, Homo sapiens
  Payload ID: 15697
  Gene Symbol: SDR39U1
  Gene Name: short chain dehydrogenase/reductase family 39U, member 1
  ENSP ID: ENSP00000452438
MAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 78799 - protein, 168 aa, Homo sapiens
  Payload ID: 15697
  Gene Symbol: SDR39U1
  Gene Name: short chain dehydrogenase/reductase family 39U, member 1
  ENSP ID: ENSP00000452499
MGRVRKGKQKPGGAVGSFKAERTPVPSLFPALGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 78800 - protein, 393 aa, Homo sapiens
  Payload ID: 15698
  Gene Symbol: SDR42E1
  Gene Name: short chain dehydrogenase/reductase family 42E, member 1
  Uniprot ID: Q8WUS8
  ENSP ID: ENSP00000332407
MDPKRSQKESVLITGGSGYFGFRLGCALNQNGVHVILFDISSPAQTIPEGIKFIQGDIRHLSDVEKAFQDADVTCVFHIASYGMSGREQLNRNLIKEVNVRGTDNILQVCQRRRVPRLVYTSTFNVIFGGQVIRNGDESLPYLPLHLHPDHYSRTKSIAEQKVLEANATPLDRGDGVLRTCALRPAGIYGPGEQRHLPRIVSYIEKGLFKFVYGDPRSLVEFVHVDNLVQAHILASEALRADKGHIASGQPYFISDGRPVNNFEFFRPLVEGLGYTFPSTRLPLTLVYCFAFLTEMVHFILGRLYNFQPFLTRTEVYKTGVTHYFSLEKAKKELGYKAQPFDLQEAVEWFKAHGHGRSSGSRDSECFVWDGLLVFLLIIAVLMWLPSSVILSL

SEQ ID NO: 78801 - protein, 195 aa, Homo sapiens
  Payload ID: 15698
  Gene Symbol: SDR42E1
  Gene Name: short chain dehydrogenase/reductase family 42E, member 1
  ENSP ID: ENSP00000434529
MHSEGLRMSQEDLDQPHLDCLGCALNQNGVHVILFDISSPAQTIPEGIKFIQGDIRHLSDVEKAFQDADVTCVFHIASYGMSGREQLNRNLIKEVNVRGTDNILQVCQRRRVPRLVYTSTFNVIFGGQVIRNGDESLPYLPLHLHPDHYSRTKSIAEQKVLEANATPLDRGDGVLRTCALRPAGIYGPGEQRHLP

SEQ ID NO: 78802 - protein, 422 aa, Homo sapiens
  Payload ID: 15699
  Gene Symbol: SDR42E2
  Gene Name: short chain dehydrogenase/reductase family 42E, member 2
  Uniprot ID: A6NKP2
  ENSP ID: ENSP00000473474
MKSNPPRSSLEACKAAGQAPQQKTQAKPTKAARQKVLVTGGGGYLGFSLGSHLAKSGTSVILLDRRRPQWELSPETKFIQADVRDEEALYRAFEGVDCVFHVASYGMSGAEKLQKEQIESINVGGTKLVIDVCVRRRVPRLIYTSTVNVAFGGKPIEQGDEDSVPYFPLDEHVDHYSRTKAIADQLTLMANGMPLPGGGTLRTCVLRPPGIYGPEEQRHLPRVAGHIKKRLFMFRFGDHKARMNWVHVHNLVQAHVLAAEALTTAKGYVASGQAYYINDGESVNLFEWMAPLFEKLGYSQPWIQVPTSWVYLTAAVMERLHLALRPICSLPPLLTRSEVRSVAVTHTFQIAKARAQLGYAPDKFRFADAVELYVQSTTRRPRGSTARTLLRLLLRLLLFLGLLALALHFLGLQPLHAAVERL

SEQ ID NO: 78803 - protein, 313 aa, Homo sapiens
  Payload ID: 15700
  Gene Symbol: SDR9C7
  Gene Name: short chain dehydrogenase/reductase family 9C, member 7
  Uniprot ID: Q8NEX9
  ENSP ID: ENSP00000293502
MAALTDLSFMYRWFKNCNLVGNLSEKYVFITGCDSGFGNLLAKQLVDRGMQVLAACFTEEGSQKLQRDTSYRLQTTLLDVTKSESIKAAAQWVRDKVGEQGLWALVNNAGVGLPSGPNEWLTKDDFVKVINVNLVGLIEVTLHMLPMVKRARGRVVNMSSSGGRVAVIGGGYCVSKFGVEAFSDSIRRELYYFGVKVCIIEPGNYRTAILGKENLESRMRKLWERLPQETRDSYGEDYFRIYTDKLKNIMQVAEPRVRDVINSMEHAIVSRSPRIRYNPGLDAKLLYIPLAKLPTPVTDFILSRYLPRPADSV

SEQ ID NO: 78804 - protein, 122 aa, Homo sapiens
  Payload ID: 15701
  Gene Symbol: SCOC
  Gene Name: short coiled-coil protein
  Uniprot ID: Q9UIL1
  ENSP ID: ENSP00000345262
MDGSRKEEEEDSTFTNISLADDIDHSSRILYPRPKSLLPKMMNADMDAVDAENQVELEEKTRLINQVLELQHTLEDLSARVDAVKEENLKLKSENQVLGQYIENLMSASSVFQTTDTKSKRK

SEQ ID NO: 78805 - protein, 82 aa, Homo sapiens
  Payload ID: 15701
  Gene Symbol: SCOC
  Gene Name: short coiled-coil protein
  ENSP ID: ENSP00000377751
MMNADMDAVDAENQVELEEKTRLINQVLELQHTLEDLSARVDAVKEENLKLKSENQVLGQYIENLMSASSVFQTTDTKSKRK

SEQ ID NO: 78806 - protein, 122 aa, Homo sapiens; identical to SEQ ID NO: 78804
  Payload ID: 15701
  Gene Symbol: SCOC
  Gene Name: short coiled-coil protein
  Uniprot ID: Q9UIL1
  ENSP ID: ENSP00000377753

SEQ ID NO: 78807 - protein, 122 aa, Homo sapiens; identical to SEQ ID NO: 78804
  Payload ID: 15701
  Gene Symbol: SCOC
  Gene Name: short coiled-coil protein
  Uniprot ID: Q9UIL1
  ENSP ID: ENSP00000377755

SEQ ID NO: 78808 - protein, 82 aa, Homo sapiens; identical to SEQ ID NO: 78805
  Payload ID: 15701
  Gene Symbol: SCOC
  Gene Name: short coiled-coil protein
  ENSP ID: ENSP00000421355

SEQ ID NO: 78809 - protein, 82 aa, Homo sapiens; identical to SEQ ID NO: 78805
  Payload ID: 15701
  Gene Symbol: SCOC
  Gene Name: short coiled-coil protein
  ENSP ID: ENSP00000424605

SEQ ID NO: 78810 - protein, 82 aa, Homo sapiens; identical to SEQ ID NO: 78805
  Payload ID: 15701
  Gene Symbol: SCOC
  Gene Name: short coiled-coil protein
  ENSP ID: ENSP00000424688

SEQ ID NO: 78811 - protein, 131 aa, Homo sapiens
  Payload ID: 15701
  Gene Symbol: SCOC
  Gene Name: short coiled-coil protein
  Uniprot ID: Q9UIL1
  ENSP ID: ENSP00000426649
MRRRVFSSQDWRASGWDGMGFFSRRTFCGRSGRSCRGQLVQVSRPEVSAGSLLLPAPQAEDHSSRILYPRPKSLLPKMMNADMDDLSARVDAVKEENLKLKSENQVLGQYIENLMSASSVFQTTDTKSKRK

SEQ ID NO: 78812 - protein, 82 aa, Homo sapiens; identical to SEQ ID NO: 78805
  Payload ID: 15701
  Gene Symbol: SCOC
  Gene Name: short coiled-coil protein
  ENSP ID: ENSP00000426810

SEQ ID NO: 78813 - protein, 159 aa, Homo sapiens
  Payload ID: 15701
  Gene Symbol: SCOC
  Gene Name: short coiled-coil protein
  Uniprot ID: Q9UIL1
  ENSP ID: ENSP00000477352
MRRRVFSSQDWRASGWDGMGFFSRRTFCGRSGRSCRGQLVQVSRPEVSAGSLLLPAPQAEDHSSRILYPRPKSLLPKMMNADMDAVDAENQVELEEKTRLINQVLELQHTLEDLSARVDAVKEENLKLKSENQVLGQYIENLMSASSVFQTTDTKSKRK

SEQ ID NO: 78814 - protein, 159 aa, Homo sapiens; identical to SEQ ID NO: 78813
  Payload ID: 15701
  Gene Symbol: SCOC
  Gene Name: short coiled-coil protein
  Uniprot ID: Q9UIL1
  ENSP ID: ENSP00000477812

SEQ ID NO: 78815 - protein, 225 aa, Homo sapiens
  Payload ID: 15702
  Gene Symbol: SHOX
  Gene Name: short stature homeobox
  Uniprot ID: O15266
  ENSP ID: ENSP00000335505
MEELTAFVSKSFDQKSKDGNGGGGGGGGKKDSITYREVLESGLARSRELGTSDSSLQDITEGGGHCPVHLFKDHVDNDKEKLKEFGTARVAEGIYECKEKREDVKSEDEDGQTKLKQRRSRTNFTLEQLNELERLFDETHYPDAFMREELSQRLGLSEARVQVWFQNRRAKCRKQENQMHKGVILGTANHLDACRVAPYVNMGALRMPFQQMEFCSCRPGWSIMA

SEQ ID NO: 78816 - protein, 225 aa, Homo sapiens; identical to SEQ ID NO: 78815
  Payload ID: 15702
  Gene Symbol: SHOX
  Gene Name: short stature homeobox
  Uniprot ID: O15266
  ENSP ID: ENSP00000370987

SEQ ID NO: 78817 - protein, 292 aa, Homo sapiens
  Payload ID: 15702
  Gene Symbol: SHOX
  Gene Name: short stature homeobox
  Uniprot ID: O15266
  ENSP ID: ENSP00000370990
MEELTAFVSKSFDQKSKDGNGGGGGGGGKKDSITYREVLESGLARSRELGTSDSSLQDITEGGGHCPVHLFKDHVDNDKEKLKEFGTARVAEGIYECKEKREDVKSEDEDGQTKLKQRRSRTNFTLEQLNELERLFDETHYPDAFMREELSQRLGLSEARVQVWFQNRRAKCRKQENQMHKGVILGTANHLDACRVAPYVNMGALRMPFQQVQAQLQLEGVAHAHPHLHPHLAAHAPYLMFPPPPFGLPIASLAESASAAAVVAAAAKSNSKNSSIADLRLKARKHAEALGL

SEQ ID NO: 78818 - protein, 292 aa, Homo sapiens; identical to SEQ ID NO: 78817
  Payload ID: 15702
  Gene Symbol: SHOX
  Gene Name: short stature homeobox
  Uniprot ID: O15266
  ENSP ID: ENSP00000452016

SEQ ID NO: 78819 - protein, 355 aa, Homo sapiens
  Payload ID: 15703
  Gene Symbol: SHOX2
  Gene Name: short stature homeobox 2
  Uniprot ID: O60902
  ENSP ID: ENSP00000374240
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEGRRKPTKAEVQATLLLPGEAFRFLVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQDSHCNVTPLSFQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 78820 - protein, 331 aa, Homo sapiens
  Payload ID: 15703
  Gene Symbol: SHOX2
  Gene Name: short stature homeobox 2
  Uniprot ID: O60902
  ENSP ID: ENSP00000397099
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQDSHCNVTPLSFQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 78821 - protein, 190 aa, Homo sapiens
  Payload ID: 15703
  Gene Symbol: SHOX2
  Gene Name: short stature homeobox 2
  ENSP ID: ENSP00000398704
MEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 78822 - protein, 319 aa, Homo sapiens
  Payload ID: 15703
  Gene Symbol: SHOX2
  Gene Name: short stature homeobox 2
  Uniprot ID: O60902
  ENSP ID: ENSP00000419362
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 78823 - protein, 146 aa, Homo sapiens
  Payload ID: 15703
  Gene Symbol: SHOX2
  Gene Name: short stature homeobox 2
  ENSP ID: ENSP00000479329
  MOD_RES (1)..(1): Any amino acid
XEKQGAGQPATDGGRKPTKAEVQATLLLPGEAFRFLVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNV

SEQ ID NO: 78824 - protein, 577 aa, Homo sapiens
  Payload ID: 15704
  Gene Symbol: SHQ1
  Gene Name: SHQ1, H/ACA ribonucleoprotein assembly factor
  Uniprot ID: Q6PI26
  ENSP ID: ENSP00000315182
MLTPAFDLSQDPDFLTIAIRVPYARVSEFDVYFEGSDFKFYAKPYFLRLTLPGRIVENGSEQGSYDADKGIFTIRLPKETPGQHFEGLNMLTALLAPRKSRTAKPLVEEIGASEIPEEVVDDEEFDWEIEQTPCEEVSESALNPQCHYGFGNLRSGVLQRLQDELSDVIDIKDPDFTPAAERRQKRLAAELAKFDPDHYLADFFEDEAIEQILKYNPWWTDKYSKMMAFLEKSQEQENHATLVSFSEEEKYQLRKFVNKSYLLDKRACRQVCYSLIDILLAYCYETRVTEGEKNVESAWNIRKLSPTLCWFETWTNVHDIMVSFGRRVLCYPLYRHFKLVMKAYRDTIKILQLGKSAVLKCLLDIHKIFQENDPAYILNDLYISDYCVWIQKVKSKKLAALAEALKEVSLTKAQLGLELEELEAAALLVQEEETALKAAHSVSGQQTLCSSSEASDSEDSDSSVSSGNEDSGSDSEQDELKDSPSETVSSLQGPFLEESSAFLIVDGGVRRNTAIQESDASQGKPLASSWPLGVSGPLIEELGEQLKTTVQVSEPKGTTAVNRSNIQERDGCQTPNN

SEQ ID NO: 78825 - protein, 50 aa, Homo sapiens
  Payload ID: 15704
  Gene Symbol: SHQ1
  Gene Name: SHQ1, H/ACA ribonucleoprotein assembly factor
  ENSP ID: ENSP00000402447
MLTPAFDLSQDPDFLTIAIRVPYARVSEFDVYFEGSDFKFYAKPYFLRTS

SEQ ID NO: 78826 - protein, 549 aa, Homo sapiens
  Payload ID: 15704
  Gene Symbol: SHQ1
  Gene Name: SHQ1, H/ACA ribonucleoprotein assembly factor
  Uniprot ID: Q6PI26
  ENSP ID: ENSP00000417452
MNKTWSLSLKNGDCSCGGPILTLPGRIVENGSEQGSYDADKGIFTIRLPKETPGQHFEGLNMLTALLAPRKSRTAKPLVEEIGASEIPEEVVDDEEFDWEIEQTPCEEVSESALNPQCHYGFGNLRSGVLQRLQDELSDVIDIKDPDFTPAAERRQKRLAAELAKFDPDHYLADFFEDEAIEQILKYNPWWTDKYSKMMAFLEKSQEQENHATLVSFSEEEKYQLRKFVNKSYLLDKRACRQVCYSLIDILLAYCYETRVTEGEKNVESAWNIRKLSPTLCWFETWTNVHDIMVSFGRRVLCYPLYRHFKLVMKAYRDTIKILQLGKSAVLKCLLDIHKIFQENDPAYILNDLYISDYCVWIQKVKSKKLAALAEALKEVSLTKAQLGLELEELEAAALLVQEEETALKAAHSVSGQQTLCSSSEASDSEDSDSSVSSGNEDSGSDSEQDELKDSPSETVSSLQGPFLEESSAFLIVDGGVRRNTAIQESDASQGKPLASSWPLGVSGPLIEELGEQLKTTVQVSEPKGTTAVNRSNIQERDGCQTPNN

SEQ ID NO: 78827 - protein, 63 aa, Homo sapiens
  Payload ID: 15704
  Gene Symbol: SHQ1
  Gene Name: SHQ1, H/ACA ribonucleoprotein assembly factor
  ENSP ID: ENSP00000417739
MLTPAFDLSQDPDFLTIAIRVPYARVSEFDVYFEGSDFKFYAKPYFLRNFYHSPAQRNPWPAF

SEQ ID NO: 78828 - protein, 110 aa, Homo sapiens
  Payload ID: 15704
  Gene Symbol: SHQ1
  Gene Name: SHQ1, H/ACA ribonucleoprotein assembly factor
  ENSP ID: ENSP00000418398
MLTALLAPRKSRTAKPLVEEIGASEIPEEVVDDEEFDWEIEQTPCEEVSESALNPQCHYGFGNLRSGVLQRLQDELSDVIDIKDPDFTPAAERRQKRLAAELAKFDPDHY

SEQ ID NO: 78829 - protein, 847 aa, Homo sapiens
  Payload ID: 15705
  Gene Symbol: SHROOM1
  Gene Name: shroom family member 1
  Uniprot ID: Q2M3G4
  ENSP ID: ENSP00000324245
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSRFLPQKEAAVMYPAELPQSSPADSEQRVSETCIVPAWLPSLPDEVFLEEAPLVRMRSPPDPHASQGPPASVHASDQPYGTGLGQRTGQVTVPTEYPLHECPGTAGADDCWQGVNGSVGISRPTSHTPTGTANDNIPTIDPTGLTTNPPTAAESDLLKPVPADALGLSGNDTPGPSHNTALARGTGQPGSRPTWPSQCLEELVQELARLDPSLCDPLASQPSPEPPLGLLDGLIPLAEVRAAMRPACGEAGEEAASTFEPGSYQFSFTQLLPAPREETRLENPATHPVLDQPCGQGLPAPNNSIQGKKVELAARLQKMLQDLHTEQERLQGEAQAWARRQAALEAAVRQACAPQELERFSRFMADLERVLGLLLLLGSRLARVRRALARAASDSDPDEQRLRLLQRQEEDAKELKEHVARRERAVREVLVRALPVEELRVYCALLAGKAAVLAQQRNLDERIRLLQDQLDAIRDDLGHHAPSPSPARPPGTCPPVQPPFPLLLT

SEQ ID NO: 78830 - protein, 783 aa, Homo sapiens
  Payload ID: 15705
  Gene Symbol: SHROOM1
  Gene Name: shroom family member 1
  ENSP ID: ENSP00000367947
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSSVHASDQPYGTGLGQRTGQVTVPTEYPLHECPGTAGADDCWQGVNGSVGISRPTSHTPTGTANDNIPTIDPTGLTTNPPTAAESDLLKPVPADALGLSGNDTPGPSHNTALARGTGQPGSRPTWPSQCLEELVQELARLDPSLCDPLASQPSPEPPLGLLDGLIPLAEVRAAMRPACGEAGEEAASTFEPGSYQFSFTQLLPAPREETRLENPATHPVLDQPCGQGLPAPNNSIQGKKVELAARLQKMLQDLHTEQERLQGEAQAWARRQAALEAAVRQACAPQELERFSRFMADLERVLGLLLLLGSRLARVRRALARAASDSDPDEQASLLQRLRLLQRQEEDAKELKEHVARRERAVREVLVRALPVEELRVYCALLAGKAAVLAQQRNLDERIRLLQDQLDAIRDDLGHHAPSPSPARPPGTCPPVQPPFPLLLT

SEQ ID NO: 78831 - protein, 852 aa, Homo sapiens
  Payload ID: 15705
  Gene Symbol: SHROOM1
  Gene Name: shroom family member 1
  Uniprot ID: Q2M3G4
  ENSP ID: ENSP00000367950
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSRFLPQKEAAVMYPAELPQSSPADSEQRVSETCIVPAWLPSLPDEVFLEEAPLVRMRSPPDPHASQGPPASVHASDQPYGTGLGQRTGQVTVPTEYPLHECPGTAGADDCWQGVNGSVGISRPTSHTPTGTANDNIPTIDPTGLTTNPPTAAESDLLKPVPADALGLSGNDTPGPSHNTALARGTGQPGSRPTWPSQCLEELVQELARLDPSLCDPLASQPSPEPPLGLLDGLIPLAEVRAAMRPACGEAGEEAASTFEPGSYQFSFTQLLPAPREETRLENPATHPVLDQPCGQGLPAPNNSIQGKKVELAARLQKMLQDLHTEQERLQGEAQAWARRQAALEAAVRQACAPQELERFSRFMADLERVLGLLLLLGSRLARVRRALARAASDSDPDEQASLLQRLRLLQRQEEDAKELKEHVARRERAVREVLVRALPVEELRVYCALLAGKAAVLAQQRNLDERIRLLQDQLDAIRDDLGHHAPSPSPARPPGTCPPVQPPFPLLLT

SEQ ID NO: 78832 - protein, 324 aa, Homo sapiens
  Payload ID: 15705
  Gene Symbol: SHROOM1
  Gene Name: shroom family member 1
  ENSP ID: ENSP00000388049
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPI

SEQ ID NO: 78833 - protein, 852 aa, Homo sapiens; identical to SEQ ID NO: 78831
  Payload ID: 15705
  Gene Symbol: SHROOM1
  Gene Name: shroom family member 1
  Uniprot ID: Q2M3G4
  ENSP ID: ENSP00000478436

SEQ ID NO: 78834 - protein, 1616 aa, Homo sapiens
  Payload ID: 15706
  Gene Symbol: SHROOM2
  Gene Name: shroom family member 2
  Uniprot ID: Q13796
  ENSP ID: ENSP00000370299
MEGAEPRARPERLAEAETRAADGGRLVEVQLSGGAPWGFTLKGGREHGEPLVITKIEEGSKAAAVDKLLAGDEIVGINDIGLSGFRQEAICLVKGSHKTLKLVVKRRSELGWRPHSWHATKFSDSHPELAASPFTSTSGCPSWSGRHHASSSSHDLSSSWEQTNLQRTLDHFSSLGSVDSLDHPSSRLSVAKSNSSIDHLGSHSKRDSAYGSFSTSSSTPDHTLSKADTSSAENILYTVGLWEAPRQGGRQAQAAGDPQGSEEKLSCFPPRVPGDSGKGPRPEYNAEPKLAAPGRSNFGPVWYVPDKKKAPSSPPPPPPPLRSDSFAATKSHEKAQGPVFSEAAAAQHFTALAQAQPRGDRRPELTDRPWRSAHPGSLGKGSGGPGCPQEAHADGSWPPSKDGASSRLQASLSSSDVRFPQSPHSGRHPPLYSDHSPLCADSLGQEPGAASFQNDSPPQVRGLSSCDQKLGSGWQGPRPCVQGDLQAAQLWAGCWPSDTALGALESLPPPTVGQSPRHHLPQPEGPPDARETGRCYPLDKGAEGCSAGAQEPPRASRAEKASQRLAASITWADGESSRICPQETPLLHSLTQEGKRRPESSPEDSATRPPPFDAHVGKPTRRSDRFATTLRNEIQMHRAKLQKSRSTVALTAAGEAEDGTGRWRAGLGGGTQEGPLAGTYKDHLKEAQARVLRATSFKRRDLDPNPGDLYPESLEHRMGDPDTVPHFWEAGLAQPPSSTSGGPHPPRIGGRRRFTAEQKLKSYSEPEKMNEVGLTRGYSPHQHPRTSEDTVGTFADRWKFFEETSKPVPQRPAQKQALHGIPRDKPERPRTAGRTCEGTEPWSRTTSLGDSLNAHSAAEKAGTSDLPRRLGTFAEYQASWKEQRKPLEARSSGRCHSADDILDVSLDPQERPQHVHGRSRSSPSTDHYKQEASVELRRQAGDPGEPREELPSAVRAEEGQSTPRQADAQCREGSPGSQQHPPSQKAPNPPTFSELSHCRGAPELPREGRGRAGTLPRDYRYSEESTPADLGPRAQSPGSPLHARGQDSWPVSSALLSKRPAPQRPPPPKREPRRYRATDGAPADAPVGVLGRPFPTPSPASLDVYVARLSLSHSPSVFSSAQPQDTPKATVCERGSQHVSGDASRPLPEALLPPKQQHLRLQTATMETSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQHEDAKELKENLDRRERIVFDILANYLSEESLADYEHFVKMKSALIIEQRELEDKIHLGEEQLKCLLDSLQPERGK

SEQ ID NO: 78835 - protein, 375 aa, Homo sapiens
  Payload ID: 15706
  Gene Symbol: SHROOM2
  Gene Name: shroom family member 2
  ENSP ID: ENSP00000406724
METSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKQELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQ

SEQ ID NO: 78836 - protein, 450 aa, Homo sapiens
  Payload ID: 15706
  Gene Symbol: SHROOM2
  Gene Name: shroom family member 2
  ENSP ID: ENSP00000415229
METSRSPSPQFAPQKLTDKPPLLIQDEDSTRIERVMDNNTTVKMVPIKIVHSESQPEKESRQSLACPAEPPALPHGLEKDQIKTLSTSEQFYSRFCLYTRQGAEPEAPHRAQPAEPQPLGTQVPPEKDRCTSPPGLSYMKAKEKTVEDLKSEELAREIVGKDKSLADILDPSVKIKTTMDLMEGIFPKDEHLLEEAQQRRKLLPKIPSPRSTEERKEEPSVPAAVSLATNSTYYSTSAPKAELLIKMKDLQEQQEHEEDSGSDLDHDLSVKKELIESISRKLQVLREARESLLEDVQANTVLGAEVEAIVKGVCKPSEFDKFRMFIGDLDKVVNLLLSLSGRLARVENALNNLDDGASPGDRQSLLEKQRVLIQQHEDAKELKENLDRRERIVFDILANYLSEESLADYEHFVKMKSALIIEQRELEDKIHLGEEQLKCLLDSLQPERGK

SEQ ID NO: 78837 - protein, 1996 aa, Homo sapiens
  Payload ID: 15707
  Gene Symbol: SHROOM3
  Gene Name: shroom family member 3
  Uniprot ID: Q8TF72
  ENSP ID: ENSP00000296043
MMRTTEDFHKPSATLNSNTATKGRYIYLEAFLEGGAPWGFTLKGGLEHGEPLIISKVEEGGKADTLSSKLQAGDEVVHINEVTLSSSRKEAVSLVKGSYKTLRLVVRRDVCTDPGHADTGASNFVSPEHLTSGPQHRKAAWSGGVKLRLKHRRSEPAGRPHSWHTTKSGEKQPDASMMQISQGMIGPPWHQSYHSSSSTSDLSNYDHAYLRRSPDQCSSQGSMESLEPSGAYPPCHLSPAKSTGSIDQLSHFHNKRDSAYSSFSTSSSILEYPHPGISGRERSGSMDNTSARGGLLEGMRQADIRYVKTVYDTRRGVSAEYEVNSSALLLQGREARASANGQGYDKWSNIPRGKGVPPPSWSQQCPSSLETATDNLPPKVGAPLPPARSDSYAAFRHRERPSSWSSLDQKRLCRPQANSLGSLKSPFIEEQLHTVLEKSPENSPPVKPKHNYTQKAQPGQPLLPTSIYPVPSLEPHFAQVPQPSVSSNGMLYPALAKESGYIAPQGACNKMATIDENGNQNGSGRPGFAFCQPLEHDLLSPVEKKPEATAKYVPSKVHFCSVPENEEDASLKRHLTPPQGNSPHSNERKSTHSNKPSSHPHSLKCPQAQAWQAGEDKRSSRLSEPWEGDFQEDHNANLWRRLEREGLGQSLSGNFGKTKSAFSSLQNIPESLRRHSSLELGRGTQEGYPGGRPTCAVNTKAEDPGRKAAPDLGSHLDRQVSYPRPEGRTGASASFNSTDPSPEEPPAPSHPHTSSLGRRGPGPGSASALQGFQYGKPHCSVLEKVSKFEQREQGSQRPSVGGSGFGHNYRPHRTVSTSSTSGNDFEETKAHIRFSESAEPLGNGEQHFKNGELKLEEASRQPCGQQLSGGASDSGRGPQRPDARLLRSQSTFQLSSEPEREPEWRDRPGSPESPLLDAPFSRAYRNSIKDAQSRVLGATSFRRRDLELGAPVASRSWRPRPSSAHVGLRSPEASASASPHTPRERHSVTPAEGDLARPVPPAARRGARRRLTPEQKKRSYSEPEKMNEVGIVEEAEPAPLGPQRNGMRFPESSVADRRRLFERDGKACSTLSLSGPELKQFQQSALADYIQRKTGKRPTSAAGCSLQEPGPLRERAQSAYLQPGPAALEGSGLASASSLSSLREPSLQPRREATLLPATVAETQQAPRDRSSSFAGGRRLGERRRGDLLSGANGGTRGTQRGDETPREPSSWGARAGKSMSAEDLLERSDVLAGPVHVRSRSSPATADKRQDVLLGQDSGFGLVKDPCYLAGPGSRSLSCSERGQEEMLPLFHHLTPRWGGSGCKAIGDSSVPSECPGTLDHQRQASRTPCPRPPLAGTQGLVTDTRAAPLTPIGTPLPSAIPSGYCSQDGQTGRQPLPPYTPAMMHRSNGHTLTQPPGPRGCEGDGPEHGVEEGTRKRVSLPQWPPPSRAKWAHAAREDSLPEESSAPDFANLKHYQKQQSLPSLCSTSDPDTPLGAPSTPGRISLRISESVLRDSPPPHEDYEDEVFVRDPHPKATSSPTFEPLPPPPPPPPSQETPVYSMDDFPPPPPHTVCEAQLDSEDPEGPRPSFNKLSKVTIARERHMPGAAHVVGSQTLASRLQTSIKGSEAESTPPSFMSVHAQLAGSLGGQPAPIQTQSLSHDPVSGTQGLEKKVSPDPQKSSEDIRTEALAKEIVHQDKSLADILDPDSRLKTTMDLMEGLFPRDVNLLKENSVKRKAIQRTVSSSGCEGKRNEDKEAVSMLVNCPAYYSVSAPKAELLNKIKEMPAEVNEEEEQADVNEKKAELIGSLTHKLETLQEAKGSLLTDIKLNNALGEEVEALISELCKPNEFDKYRMFIGDLDKVVNLLLSLSGRLARVENVLSGLGEDASNEERSSLYEKRKILAGQHEDARELKENLDRRERVVLGILANYLSEEQLQDYQHFVKMKSTLLIEQRKLDDKIKLGQEQVKCLLESLPSDFIPKAGALALPPNLTSEPIPAGGCTFSGIFPTLTSPL

SEQ ID NO: 78838 - protein, 1493 aa, Homo sapiens
  Payload ID: 15708
  Gene Symbol: SHROOM4
  Gene Name: shroom family member 4
  Uniprot ID: Q9ULL8
  ENSP ID: ENSP00000289292
MENRPGSFQYVPVQLQGGAPWGFTLKGGLEHCEPLTVSKIEDGGKAALSQKMRTGDELVNINGTPLYGSRQEALILIKGSFRILKLIVRRRNAPVSRPHSWHVAKLLEGCPEAATTMHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQQKQQQQQQKQQEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 78839 - protein, 1493 aa, Homo sapiens; identical to SEQ ID NO: 78838
  Payload ID: 15708
  Gene Symbol: SHROOM4
  Gene Name: shroom family member 4
  Uniprot ID: Q9ULL8
  ENSP ID: ENSP00000365188

SEQ ID NO: 78840 - protein, 1377 aa, Homo sapiens
  Payload ID: 15708
  Gene Symbol: SHROOM4
  Gene Name: shroom family member 4
  Uniprot ID: Q9ULL8
  ENSP ID: ENSP00000421450
MHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQQKQQQQQQKQQEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 78841 - protein, 561 aa, Homo sapiens
  Payload ID: 15709
  Gene Symbol: SGOL1
  Gene Name: shugoshin-like 1 (S. pombe)
  Uniprot ID: Q5FBB7
  ENSP ID: ENSP00000263753
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSGEAKSTDNVLPRTVSVRSSLKKHCNSICQFDSLDDFETSHLAGKSFEFERVGFLDPLVNMHIPENVQHNACQWSKDQVNLSPKLIQPGTFTKTKEDILESKSEQTKSKQRDTQERKREEKRKANRRKSKRMSKYKENKSENKKTVPQKKMHKSVSSNDAYNFNLEEGVHLTPFRQKVSNDSNREENNESEVSLCESSGSGDDSDDLYLPTCKYIQNPTSNSDRPVTRPLAKRALKYTDEKETEGSKPTKTPTTTPPETQQSPHLSLKDITNVSLYPVVKIRRLSLSPKKNKASPAVALPKRRCTASVNYKEPTLASKLRRGDPFTDLCFLNSPIFKQKKDLRRSKKRALEVSPAKEAIFILYYVREFVSRFPDCRKCKLETHICLR

SEQ ID NO: 78842 - protein, 292 aa, Homo sapiens
  Payload ID: 15709
  Gene Symbol: SGOL1
  Gene Name: shugoshin-like 1 (S. pombe)
  Uniprot ID: Q5FBB7
  ENSP ID: ENSP00000306581
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEATPPETQQSPHLSLKDITNVSLYPVVKIRRLSLSPKKNKASPAVALPKRRCTASVNYKEPTLASKLRRGDPFTDLCFLNSPIFKQKKDLRRSKKRALEVSPAKEAIFILYYVREFVSRFPDCRKCKLETHICLR

SEQ ID NO: 78843 - protein, 275 aa, Homo sapiens
  Payload ID: 15709
  Gene Symbol: SGOL1
  Gene Name: shugoshin-like 1 (S. pombe)
  Uniprot ID: Q5FBB7
  ENSP ID: ENSP00000389034
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSATPPETQQSPHLSLKDITNVSLYPVVKIRRLSLSPKKNKASPAVALPKRRCTASVNYKEPTLASKLRRGDPFTDLCFLNSPIFKQKKDLRRSKKSMKQIQ

SEQ ID NO: 78844 - protein, 275 aa, Homo sapiens; identical to SEQ ID NO: 78843
  Payload ID: 15709
  Gene Symbol: SGOL1
  Gene Name: shugoshin-like 1 (S. pombe)
  Uniprot ID: Q5FBB7
  ENSP ID: ENSP00000394613

SEQ ID NO: 78845 - protein, 309 aa, Homo sapiens
  Payload ID: 15709
  Gene Symbol: SGOL1
  Gene Name: shugoshin-like 1 (S. pombe)
  Uniprot ID: Q5FBB7
  ENSP ID: ENSP00000394625
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSATPPETQQSPHLSLKDITNVSLYPVVKIRRLSLSPKKNKASPAVALPKRRCTASVNYKEPTLASKLRRGDPFTDLCFLNSPIFKQKKDLRRSKKRALEVSPAKEAIFILYYVREFVSRFPDCRKCKLETHICLR

SEQ ID NO: 78846 - protein, 258 aa, Homo sapiens
  Payload ID: 15709
  Gene Symbol: SGOL1
  Gene Name: shugoshin-like 1 (S. pombe)
  Uniprot ID: Q5FBB7
  ENSP ID: ENSP00000394957
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEATPPETQQSPHLSLKDITNVSLYPVVKIRRLSLSPKKNKASPAVALPKRRCTASVNYKEPTLASKLRRGDPFTDLCFLNSPIFKQKKDLRRSKKSMKQIQ

SEQ ID NO: 78847 - protein, 84 aa, Homo sapiens
  Payload ID: 15709
  Gene Symbol: SGOL1
  Gene Name: shugoshin-like 1 (S. pombe)
  ENSP ID: ENSP00000397672
MAKERCLKKSFQDSLEDIKKRMKEKRNKNLAEIGKRRSFIAAPCQIITNTSTLLKNYQDNNKITRKYVPLEWTPIVMTAPEIYL

SEQ ID NO: 78848 - protein, 527 aa, Homo sapiens
  Payload ID: 15709
  Gene Symbol: SGOL1
  Gene Name: shugoshin-like 1 (S. pombe)
  Uniprot ID: Q5FBB7
  ENSP ID: ENSP00000410458
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSGEAKSTDNVLPRTVSVRSSLKKHCNSICQFDSLDDFETSHLAGKSFEFERVGFLDPLVNMHIPENVQHNACQWSKDQVNLSPKLIQPGTFTKTKEDILESKSEQTKSKQRDTQERKREEKRKANRRKSKRMSKYKENKSENKKTVPQKKMHKSVSSNDAYNFNLEEGVHLTPFRQKVSNDSNREENNESEVSLCESSGSGDDSDDLYLPTCKYIQNPTSNSDRPVTRPLAKRALKYTDEKETEGSKPTKTPTTTPPETQQSPHLSLKDITNVSLYPVVKIRRLSLSPKKNKASPAVALPKRRCTASVNYKEPTLASKLRRGDPFTDLCFLNSPIFKQKKDLRRSKKSMKQIQ

SEQ ID NO: 78849 - protein, 292 aa, Homo sapiens; identical to SEQ ID NO: 78842
  Payload ID: 15709
  Gene Symbol: SGOL1
  Gene Name: shugoshin-like 1 (S. pombe)
  Uniprot ID: Q5FBB7
  ENSP ID: ENSP00000411200

SEQ ID NO: 78850 - protein, 215 aa, Homo sapiens
  Payload ID: 15709
  Gene Symbol: SGOL1
  Gene Name: shugoshin-like 1 (S. pombe)
  Uniprot ID: Q5FBB7
  ENSP ID: ENSP00000413070
MAKERCLKKSFQDSLEDIKKRMKEKRNKNLAEIGKRRSFIAAPCQIITNTSTLLKNYQDNNKMLVLALENEKSKVKEAQDIILQLRKECYYLTCQLYALKGKLTSQQTVEPAQNQEICSSGMDPNSDDSSRNLFVKDLPQIPLEETELPGQGESFQIEDQIPTIPQDTLGVDFDSGALEVSPAKEAIFILYYVREFVSRFPDCRKCKLETHICLR

SEQ ID NO: 78851 - protein, 561 aa, Homo sapiens; identical to SEQ ID NO: 78841
  Payload ID: 15709
  Gene Symbol: SGOL1
  Gene Name: shugoshin-like 1 (S. pombe)
  Uniprot ID: Q5FBB7
  ENSP ID: ENSP00000414129

SEQ ID NO: 78852 - protein, 309 aa, Homo sapiens; identical to SEQ ID NO: 78845
  Payload ID: 15709
  Gene Symbol: SGOL1
  Gene Name: shugoshin-like 1 (S. pombe)
  Uniprot ID: Q5FBB7
  ENSP ID: ENSP00000414960

SEQ ID NO: 78853 - protein, 1265 aa, Homo sapiens
  Payload ID: 15710
  Gene Symbol: SGOL2
  Gene Name: shugoshin-like 2 (S. pombe)
  Uniprot ID: Q562F6
  ENSP ID: ENSP00000350447
MECPVMETGSLFTSGIKRHLKDKRISKTTKLNVSLASKIKTKILNNSSIFKISLKHNNRALAQALSREKENSRRITTEKMLLQKEVEKLNFENTFLRLKLNNLNKKLIDIEALMNNNLITAIEMSSLSEFHQSSFLLSASKKKRISKQCKLMRLPFARVPLTSNDDEDEDKEKMQCDNNIKSKTLPDIPSSGSTTQPLSTQDNSEVLFLKENNQNVYGLDDSEHISSIVDVPPRESHSHSDQSSKTSLMSEMRNAQSIGRRWEKPSPSNVTERKKRGSSWESNNLSADTPCATVLDKQHISSPELNCNNEINGHTNETNTEMQRNKQDLPGLSSESAREPNAECMNQIEDNDDFQLQKTVYDADMDLTASEVSKIVTVSTGIKKKSNKKTNEHGMKTFRKVKDSSSEKKRERSKRQFKNSSDVDIGEKIENRTERSDVLDGKRGAEDPGFIFNNEQLAQMNEQLAQVNELKKMTLQTGFEQGDRENVLCNKKEKRITNEQEETYSLSQSSGKFHQESKFDKGQNSLTCNKSKASRQTFVIHKLEKDNLLPNQKDKVTIYENLDVTNEFHTANLSTKDNGNLCDYGTHNILDLKKYVTDIQPSEQNESNINKLRKKVNRKTEIISGMNHMYEDNDKDVVHGLKKGNFFFKTQEDKEPISENIEVSKELQIPALSTRDNENQCDYRTQNVLGLQKQITNMYPVQQNESKVNKKLRQKVNRKTEIISEVNHLDNDKSIEYTVKSHSLFLTQKDKEIIPGNLEDPSEFETPALSTKDSGNLYDSEIQNVLGVKHGHDMQPACQNDSKIGKKPRLNVCQKSEIIPETNQIYENDNKGVHDLEKDNFFSLTPKDKETISENLQVTNEFQTVDLLIKDNGNLCDYDTQNILELKKYVTDRKSAEQNESKINKLRNKVNWKTEIISEMNQIYEDNDKDAHVQESYTKDLDFKVNKSKQKLECQDIINKHYMEVNSNEKESCDQILDSYKVVKKRKKESSCKAKNILTKAKNKLASQLTESSQTSISLESDLKHITSEADSDPGNPVELCKTQKQSTTTLNKKDLPFVEEIKEGECQVKKVNKMTSKSKKRKTSIDPSPESHEVMERILDSVQGKSTVSEQADKENNLENEKMVKNKPDFYTKAFRSLSEIHSPNIQDSSFDSVREGLVPLSVSSGKNVIIKENFALECSPAFQVSDDEHEKMNKMKFKVNRRTQKSGIGDRPLQDLSNTSFVSNNTAESENKSEDLSSERTSRRRRCTPFYFKEPSLRDKMRR

SEQ ID NO: 78854 - protein, 247 aa, Homo sapiens
  Payload ID: 15710
  Gene Symbol: SGOL2
  Gene Name: shugoshin-like 2 (S. pombe)
  Uniprot ID: Q562F6
  ENSP ID: ENSP00000386249
MECPVMETGSLFTSGIKRHLKDKRISKTTKLNVSLASKIKTKILNNSSIFKISLKHNNRALAQALSREKENSRRITTEKMLLQKEVEKLNFENTFLRLKLNNLNKKLIDIEALMNNNLITAIEMSSLSEFHQSSFLLSASKKKRISKQCKLMRLPFARVPLTSNDDEDEDKEKMQCDNNIKSKTLPDIPSSGSTTQPLSTQDNSEVLFLKENNQNVYGLDDSEHISSIVDVPPRGEIVLKIHFEYLY

SEQ ID NO: 78855 - protein, 87 aa, Homo sapiens
  Payload ID: 15710
  Gene Symbol: SGOL2
  Gene Name: shugoshin-like 2 (S. pombe)
  ENSP ID: ENSP00000393325
MECPVMETGSLFTSGIKRHLKDKRISKTTKLNVSLASKIKTKILNNSSIFKISLKHNNRALAQALSREKENSRRITTEKMLLQKEVE

SEQ ID NO: 78856 - protein, 250 aa, Homo sapiens
  Payload ID: 15711
  Gene Symbol: SBDS
  Gene Name: Shwachman-Bodian-Diamond syndrome
  Uniprot ID: Q9Y3A5
  ENSP ID: ENSP00000246868
MSIFTPTNQIRLTNVAVVRMKRAGKRFEIACYKNKVVGWRSGVEKDLDEVLQTHSVFVNVSKGQVAKKEDLISAFGTDDQTEICKQILTKGEVQVSDKERHTQLEQMFRDIATIVADKCVNPETKRPYTVILIERAMKDIHYSVKTNKSTKQQALEVIKQLKEKMKIERAHMRLRFILPVNEGKKLKEKLKPLIKVIESEDYGQQLEIVCLIDPGCFREIDELIKKETKGKGSLEVLNLKDVEEGDEKFE

SEQ ID NO: 78857 - protein, 86 aa, Homo sapiens
  Payload ID: 15711
  Gene Symbol: SBDS
  Gene Name: Shwachman-Bodian-Diamond syndrome
  ENSP ID: ENSP00000394586
MSIFTPTNQIRLTNVAVVRMKRAGKRFEIACYKNKVVGWRSGVEKDLDEVLQTHSVFVNVSKGQVAKKEDLISAFGTDDQTEIYFD

SEQ ID NO: 78858 - protein, 250 aa, Homo sapiens [sequence omitted]

SEQ ID NO: 78859 - protein, 313 aa, Homo sapiens
  Payload ID: 15712
  Gene Symbol: SIAH1
  Gene Name: siah E3 ubiquitin protein ligase 1
  Uniprot ID: Q8IUQ4
  ENSP ID: ENSP00000349156
MTGKATPPSLYSWRGVLFTCLPAARTRKRKEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 78860 - protein, 282 aa, Homo sapiens
  Payload ID: 15712
  Gene Symbol: SIAH1
  Gene Name: siah E3 ubiquitin protein ligase 1
  Uniprot ID: Q8IUQ4
  ENSP ID: ENSP00000369343
MSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 78861 - protein, 282 aa, Homo sapiens; identical to SEQ ID NO: 78860
  Payload ID: 15712
  Gene Symbol: SIAH1
  Gene Name: siah E3 ubiquitin protein ligase 1
  Uniprot ID: Q8IUQ4
  ENSP ID: ENSP00000378214

SEQ ID NO: 78862 - protein, 282 aa, Homo sapiens; identical to SEQ ID NO: 78860
  Payload ID: 15712
  Gene Symbol: SIAH1
  Gene Name: siah E3 ubiquitin protein ligase 1
  Uniprot ID: Q8IUQ4
  ENSP ID: ENSP00000456421

SEQ ID NO: 78863 - protein, 98 aa, Homo sapiens
  Payload ID: 15712
  Gene Symbol: SIAH1
  Gene Name: siah E3 ubiquitin protein ligase 1
  ENSP ID: ENSP00000457415
MSRQTATALPTGTSKCPPSQRVPALTGTTASNNDLASLFECPVCFDYVLPPILQCQSGHLVCSNCRPKLTCCPTCRGPLGSIRNLAMEKVANSVLFPC

SEQ ID NO: 78864 - protein, 324 aa, Homo sapiens
  Payload ID: 15713
  Gene Symbol: SIAH2
  Gene Name: siah E3 ubiquitin protein ligase 2
  Uniprot ID: O43255
  ENSP ID: ENSP00000322457
MSRPSSTGPSANKPCSKQPPPQPQHTPSPAAPPAAATISAAGPGSSAVPAAAAVISGPGGGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCP

SEQ ID NO: 78865 - protein, 83 aa, Homo sapiens
  Payload ID: 15713
  Gene Symbol: SIAH2
  Gene Name: siah E3 ubiquitin protein ligase 2
  ENSP ID: ENSP00000417619
MEKVASAVLFPCKYATTGCSLTLHHTEKPEHEDICEYRPYSCPCPGASCKWQGSLEAVMSHLMHAHKSITTLQGEDIVFLATD

SEQ ID NO: 78866 - protein, 269 aa, Homo sapiens
  Payload ID: 15714
  Gene Symbol: SIAH3
  Gene Name: siah E3 ubiquitin protein ligase family member 3
  Uniprot ID: Q8IW03
  ENSP ID: ENSP00000383256
MLFFTQCFGAVLDLIHLRFQHYKAKRVFSAAGQLVCVVNPTHNLKYVSSRRAVTQSAPEQGSFHPHHLSHHHCHHRHHHHLRHHAHPHHLHHQEAGLHANPVTPCLCMCPLFSCQWEGRLEVVVPHLRQIHRVDILQGAEIVFLATDMHLPAPADWIIMHSCLGHHFLLVLRKQERHEGHPQFFATMMLIGTPTQADCFTYRLELNRNHRRLKWEATPRSVLECVDSVITDGDCLVLNTSLAQLFSDNGSLAIGIAITATEVLPSEAEM

SEQ ID NO: 78867 - protein, 523 aa, Homo sapiens
  Payload ID: 15715
  Gene Symbol: SIAE
  Gene Name: sialic acid acetylesterase
  Uniprot ID: Q9HAT2
  ENSP ID: ENSP00000263593
MVAPGLVLGLVLPLILWADRSAGIGFRFASYINNDMVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 78868 - protein, 488 aa, Homo sapiens
  Payload ID: 15715
  Gene Symbol: SIAE
  Gene Name: sialic acid acetylesterase
  Uniprot ID: Q9HAT2
  ENSP ID: ENSP00000437877
MVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 78869 - protein, 488 aa, Homo sapiens; identical to SEQ ID NO: 78868
  Payload ID: 15715
  Gene Symbol: SIAE
  Gene Name: sialic acid acetylesterase
  Uniprot ID: Q9HAT2
  ENSP ID: ENSP00000478211

SEQ ID NO: 78870 - protein, 1709 aa, Homo sapiens
  Payload ID: 15716
  Gene Symbol: SIGLEC1
  Gene Name: sialic acid binding Ig-like lectin 1, sialoadhesin
  Uniprot ID: Q9BZZ2
  ENSP ID: ENSP00000341141
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWRRRRVCKQSMGENSVEMAFQKETTQLIDPDAATCETSTCAPPLG

SEQ ID NO: 78871 - protein, 463 aa, Homo sapiens
  Payload ID: 15716
  Gene Symbol: SIGLEC1
  Gene Name: sialic acid binding Ig-like lectin 1, sialoadhesin
  ENSP ID: ENSP00000395778
  MOD_RES (1)..(1): Any amino acid
XLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRGEGRGLHLPGHSAQKPSS

SEQ ID NO: 78872 - protein, 602 aa, Homo sapiens
  Payload ID: 15717
  Gene Symbol: SIGLEC10
  Gene Name: sialic acid binding Ig-like lectin 10
  Uniprot ID: Q96LC7
  ENSP ID: ENSP00000342389
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 78873 - protein, 697 aa, Homo sapiens
  Payload ID: 15717
  Gene Symbol: SIGLEC10
  Gene Name: sialic acid binding Ig-like lectin 10
  Uniprot ID: Q96LC7
  ENSP ID: ENSP00000345243
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 78874 - protein, 639 aa, Homo sapiens
  Payload ID: 15717
  Gene Symbol: SIGLEC10
  Gene Name: sialic acid binding Ig-like lectin 10
  Uniprot ID: Q96LC7
  ENSP ID: ENSP00000389132
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 78875 - protein, 454 aa, Homo sapiens
  Payload ID: 15717
  Gene Symbol: SIGLEC10
  Gene Name: sialic acid binding Ig-like lectin 10
  Uniprot ID: Q96LC7
  ENSP ID: ENSP00000395475
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPDPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 78876 - protein, 544 aa, Homo sapiens
  Payload ID: 15717
  Gene Symbol: SIGLEC10
  Gene Name: sialic acid binding Ig-like lectin 10
  Uniprot ID: Q96LC7
  ENSP ID: ENSP00000408387
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 78877 - protein, 554 aa, Homo sapiens
  Payload ID: 15717
  Gene Symbol: SIGLEC10
  Gene Name: sialic acid binding Ig-like lectin 10
  Uniprot ID: Q96LC7
  ENSP ID: ENSP00000414324
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 78878 - protein, 512 aa, Homo sapiens
  Payload ID: 15717
  Gene Symbol: SIGLEC10
  Gene Name: sialic acid binding Ig-like lectin 10
  ENSP ID: ENSP00000431444
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPDPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 78879 - protein, 186 aa, Homo sapiens
  Payload ID: 15717
  Gene Symbol: SIGLEC10
  Gene Name: sialic acid binding Ig-like lectin 10
  ENSP ID: ENSP00000433838
MRRCYCHCCCPRCWADWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDF

SEQ ID NO: 78880 - protein, 155 aa, Homo sapiens
  Payload ID: 15717
  Gene Symbol: SIGLEC10
  Gene Name: sialic acid binding Ig-like lectin 10
  ENSP ID: ENSP00000435281
MLLPLLLSSLLGVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQ

SEQ ID NO: 78881 - protein, 602 aa, Homo sapiens
  Payload ID: 15718
  Gene Symbol: SIGLEC11
  Gene Name: sialic acid binding Ig-like lectin 11
  Uniprot ID: Q96RL6
  ENSP ID: ENSP00000398891
MVPGQAQPQSPEMLLLPLLLPVLGAGSLNKDPSYSLQVQRQVPVPEGLCVIVSCNLSYPRDGWDESTAAYGYWFKGRTSPKTGAPVATNNQSREVEMSTRDRFQLTGDPGKGSCSLVIRDAQREDEAWYFFRVERGSRVRHSFLSNAFFLKVTALTKKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQQALDLSVQYPPENLRVMVSQANRTVLENLGNGTSLPVLEGQSLRLVCVTHSSPPARLSWTRWGQTVGPSQPSDPGVLELPPIQMEHEGEFTCHAQHPLGSQHVSLSLSVHWKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPK

SEQ ID NO: 78882 - protein, 60 aa, Homo sapiens
  Payload ID: 15718
  Gene Symbol: SIGLEC11
  Gene Name: sialic acid binding Ig-like lectin 11
  ENSP ID: ENSP00000407387
  MOD_RES (1)..(1): Any amino acid
XLLEGNSSQGSFEVTPSSAGPWANSSLSLHGGLSSGLRLRCKAWNVHGAQSGSVFQLLPG

SEQ ID NO: 78883 - protein, 698 aa, Homo sapiens
  Payload ID: 15718
  Gene Symbol: SIGLEC11
  Gene Name: sialic acid binding Ig-like lectin 11
  Uniprot ID: Q96RL6
  ENSP ID: ENSP00000412361
MVPGQAQPQSPEMLLLPLLLPVLGAGSLNKDPSYSLQVQRQVPVPEGLCVIVSCNLSYPRDGWDESTAAYGYWFKGRTSPKTGAPVATNNQSREVEMSTRDRFQLTGDPGKGSCSLVIRDAQREDEAWYFFRVERGSRVRHSFLSNAFFLKVTALTKKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQQALDLSVQYPPENLRVMVSQANRTVLENLGNGTSLPVLEGQSLRLVCVTHSSPPARLSWTRWGQTVGPSQPSDPGVLELPPIQMEHEGEFTCHAQHPLGSQHVSLSLSVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPK

SEQ ID NO: 78884 - protein, 595 aa, Homo sapiens
  Payload ID: 15719
  Gene Symbol: SIGLEC12
  Gene Name: sialic acid binding Ig-like lectin 12 (gene/pseudogene)
  Uniprot ID: Q96PQ1
  ENSP ID: ENSP00000291707
MLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPK

SEQ ID NO: 78885 - protein, 154 aa, Homo sapiens
  Payload ID: 15719
  Gene Symbol: SIGLEC12
  Gene Name: sialic acid binding Ig-like lectin 12 (gene/pseudogene)
  ENSP ID: ENSP00000469791
MLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTGGERKQEMELHI

SEQ ID NO: 78886 - protein, 477 aa, Homo sapiens
  Payload ID: 15719
  Gene Symbol: SIGLEC12
  Gene Name: sialic acid binding Ig-like lectin 12 (gene/pseudogene)
  Uniprot ID: Q96PQ1
  ENSP ID: ENSP00000472873
MLLPLLWANEERDSGGWADPRFSTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPK

SEQ ID NO: 78887 - protein, 396 aa, Homo sapiens
  Payload ID: 15720
  Gene Symbol: SIGLEC14
  Gene Name: sialic acid binding Ig-like lectin 14
  Uniprot ID: Q08ET2
  ENSP ID: ENSP00000354090
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQVKRQGAQVTTERTVQLNVSYAPQNLAISIFFRNGTGTALRILSNGMSVPIQEGQSLFLACTVDSNPPASLSWFREGKALNPSQTSMSGTLELPNIGAREGGEFTCRVQHPLGSQHLSFILSVQRSSSSCICVTEKQQGSWPLVLTLIRGALMGAGFLLTYGLTWIYYTRCGGPQQSRAERPG

SEQ ID NO: 78888 - protein, 328 aa, Homo sapiens
  Payload ID: 15721
  Gene Symbol: SIGLEC15
  Gene Name: sialic acid binding Ig-like lectin 15
  Uniprot ID: Q6ZMC9
  ENSP ID: ENSP00000374125
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 78889 - protein, 174 aa, Homo sapiens
  Payload ID: 15721
  Gene Symbol: SIGLEC15
  Gene Name: sialic acid binding Ig-like lectin 15
  Uniprot ID: Q6ZMC9
  ENSP ID: ENSP00000443509
MTATRAATASGSAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 78890 - protein, 174 aa, Homo sapiens
  Payload ID: 15721
  Gene Symbol: SIGLEC15
  Gene Name: sialic acid binding Ig-like lectin 15
  ENSP ID: ENSP00000466774
  MOD_RES (1)..(1): Any amino acid
XGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRPTTCPVSLFADLLSHQRP

SEQ ID NO: 78891 - protein, 551 aa, Homo sapiens; identical to SEQ ID NO: 1068
  Payload ID: 15722
  Gene Symbol: SIGLEC5
  Gene Name: sialic acid binding Ig-like lectin 5
  Uniprot ID: O15389
  ENSP ID: ENSP00000455510

SEQ ID NO: 78892 - protein, 551 aa, Homo sapiens; identical to SEQ ID NO: 1068
  Payload ID: 15722
  Gene Symbol: SIGLEC5
  Gene Name: sialic acid binding Ig-like lectin 5
  Uniprot ID: O15389
  ENSP ID: ENSP00000473238

SEQ ID NO: 78893 - protein, 437 aa, Homo sapiens
  Payload ID: 15723
  Gene Symbol: SIGLEC6
  Gene Name: sialic acid binding Ig-like lectin 6
  Uniprot ID: O43699
  ENSP ID: ENSP00000344064
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 78894 - protein, 353 aa, Homo sapiens
  Payload ID: 15723
  Gene Symbol: SIGLEC6
  Gene Name: sialic acid binding Ig-like lectin 6
  Uniprot ID: O43699
  ENSP ID: ENSP00000345907
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 78895 - protein, 389 aa, Homo sapiens
  Payload ID: 15723
  Gene Symbol: SIGLEC6
  Gene Name: sialic acid binding Ig-like lectin 6
  Uniprot ID: O43699
  ENSP ID: ENSP00000353071
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSWMLRRPPLSTPDAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVISTSSRQA

SEQ ID NO: 78896 - protein, 342 aa, Homo sapiens
  Payload ID: 15723
  Gene Symbol: SIGLEC6
  Gene Name: sialic acid binding Ig-like lectin 6
  Uniprot ID: O43699
  ENSP ID: ENSP00000375674
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 78897 - protein, 453 aa, Homo sapiens
  Payload ID: 15723
  Gene Symbol: SIGLEC6
  Gene Name: sialic acid binding Ig-like lectin 6
  Uniprot ID: O43699
  ENSP ID: ENSP00000401502
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 78898 - protein, 401 aa, Homo sapiens
  Payload ID: 15723
  Gene Symbol: SIGLEC6
  Gene Name: sialic acid binding Ig-like lectin 6
  Uniprot ID: O43699
  ENSP ID: ENSP00000410679
MQGAQEASASEMLPLLLPLLWAASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 78899 - protein, 374 aa, Homo sapiens
  Payload ID: 15724
  Gene Symbol: SIGLEC7
  Gene Name: sialic acid binding Ig-like lectin 7
  Uniprot ID: Q9Y286
  ENSP ID: ENSP00000306757
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTDPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 78900 - protein, 467 aa, Homo sapiens
  Payload ID: 15724
  Gene Symbol: SIGLEC7
  Gene Name: sialic acid binding Ig-like lectin 7
  Uniprot ID: Q9Y286
  ENSP ID: ENSP00000323328
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 78901 - protein, 145 aa, Homo sapiens
  Payload ID: 15724
  Gene Symbol: SIGLEC7
  Gene Name: sialic acid binding Ig-like lectin 7
  Uniprot ID: Q9Y286
  ENSP ID: ENSP00000437609
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTE

SEQ ID NO: 78902 - protein, 185 aa, Homo sapiens
  Payload ID: 15724
  Gene Symbol: SIGLEC7
  Gene Name: sialic acid binding Ig-like lectin 7
  ENSP ID: ENSP00000469626
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTAPAPRHQPHLSGDLAWGRRDHEQDHPTQCVLSPCLSVPDPP

SEQ ID NO: 78903 - protein, 145 aa, Homo sapiens
  Payload ID: 15724
  Gene Symbol: SIGLEC7
  Gene Name: sialic acid binding Ig-like lectin 7
  Uniprot ID: Q9Y286
  ENSP ID: ENSP00000472529
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTG

SEQ ID NO: 78904 - protein, 499 aa, Homo sapiens
  Payload ID: 15725
  Gene Symbol: SIGLEC8
  Gene Name: sialic acid binding Ig-like lectin 8
  Uniprot ID: Q9NYZ4
  ENSP ID: ENSP00000321077
MLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTALTHRPDILILGTLESGHSRNLTCSVPWACKQGTPPMISWIGASVSSPGPTTARSSVLTLTPKPQDHGTSLTCQVTLPGTGVTTTSTVRLDVSYPPWNLTMTVFQGDATASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRG

SEQ ID NO: 78905 - protein, 406 aa, Homo sapiens
  Payload ID: 15725
  Gene Symbol: SIGLEC8
  Gene Name: sialic acid binding Ig-like lectin 8
  Uniprot ID: Q9NYZ4
  ENSP ID: ENSP00000339448
MLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTDPPWNLTMTVFQGDATASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRG

SEQ ID NO: 78906 - protein, 390 aa, Homo sapiens
  Payload ID: 15725
  Gene Symbol: SIGLEC8
  Gene Name: sialic acid binding Ig-like lectin 8
  ENSP ID: ENSP00000389142
MLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRG

SEQ ID NO: 78907 - protein, 463 aa, Homo sapiens
  Payload ID: 15726
  Gene Symbol: SIGLEC9
  Gene Name: sialic acid binding Ig-like lectin 9
  Uniprot ID: Q9Y336
  ENSP ID: ENSP00000250360
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 78908 - protein, 479 aa, Homo sapiens
  Payload ID: 15726
  Gene Symbol: SIGLEC9
  Gene Name: sialic acid binding Ig-like lectin 9
  Uniprot ID: Q9Y336
  ENSP ID: ENSP00000413861
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQILNHFIGFPTFLGLGFEFLLNLRDLCCHPDSEFYVYHFSHFRLIKNIAGEIVWSLEGKILWLLDVSDFFHWFFLICVG

SEQ ID NO: 78909 - protein, 205 aa, Homo sapiens
  Payload ID: 15726
  Gene Symbol: SIGLEC9
  Gene Name: sialic acid binding Ig-like lectin 9
  ENSP ID: ENSP00000472483
  MOD_RES (1)..(1): Any amino acid
XSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQKTSSSSSSAFEQLFPHPSIPFRAEASKYYLSGTDRNYFRLHGPHSLIAAPQIC

SEQ ID NO: 78910 - protein, 415 aa, Homo sapiens
  Payload ID: 15727
  Gene Symbol: NEU1
  Gene Name: sialidase 1 (lysosomal sialidase)
  Uniprot ID: Q99519
  ENSP ID: ENSP00000229725
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQLWPGPSGYSSLATLEGSMDGEEQAPQLYVLYEKGRNHYTESISVAKISVYGTL

SEQ ID NO: 78911 - protein, 415 aa, Homo sapiens; identical to SEQ ID NO: 78910
  Payload ID: 15727
  Gene Symbol: NEU1
  Gene Name: sialidase 1 (lysosomal sialidase)
  Uniprot ID: Q99519
  ENSP ID: ENSP00000364782

SEQ ID NO: 78912 - protein, 415 aa, Homo sapiens; identical to SEQ ID NO: 78910
  Payload ID: 15727
  Gene Symbol: NEU1
  Gene Name: sialidase 1 (lysosomal sialidase)
  Uniprot ID: Q99519
  ENSP ID: ENSP00000399309

SEQ ID NO: 78913 - protein, 415 aa, Homo sapiens; identical to SEQ ID NO: 78910
  Payload ID: 15727
  Gene Symbol: NEU1
  Gene Name: sialidase 1 (lysosomal sialidase)
  Uniprot ID: Q99519
  ENSP ID: ENSP00000401067

SEQ ID NO: 78914 - protein, 415 aa, Homo sapiens; identical to SEQ ID NO: 78910
  Payload ID: 15727
  Gene Symbol: NEU1
  Gene Name: sialidase 1 (lysosomal sialidase)
  Uniprot ID: Q99519
  ENSP ID: ENSP00000403720

SEQ ID NO: 78915 - protein, 415 aa, Homo sapiens; identical to SEQ ID NO: 78910
  Payload ID: 15727
  Gene Symbol: NEU1
  Gene Name: sialidase 1 (lysosomal sialidase)
  Uniprot ID: Q99519
  ENSP ID: ENSP00000408207

SEQ ID NO: 78916 - protein, 415 aa, Homo sapiens; identical to SEQ ID NO: 78910
  Payload ID: 15727
  Gene Symbol: NEU1
  Gene Name: sialidase 1 (lysosomal sialidase)
  Uniprot ID: Q99519
  ENSP ID: ENSP00000408957

SEQ ID NO: 78917 - protein, 415 aa, Homo sapiens; identical to SEQ ID NO: 78910
  Payload ID: 15727
  Gene Symbol: NEU1
  Gene Name: sialidase 1 (lysosomal sialidase)
  Uniprot ID: Q99519
  ENSP ID: ENSP00000409489

SEQ ID NO: 78918 - protein, 267 aa, Homo sapiens
  Payload ID: 15727
  Gene Symbol: NEU1
  Gene Name: sialidase 1 (lysosomal sialidase)
  ENSP ID: ENSP00000431628
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQL

SEQ ID NO: 78919 - protein, 267 aa, Homo sapiens; identical to SEQ ID NO: 78918
  Payload ID: 15727
  Gene Symbol: NEU1
  Gene Name: sialidase 1 (lysosomal sialidase)
  ENSP ID: ENSP00000432028

SEQ ID NO: 78920 - protein, 267 aa, Homo sapiens; identical to SEQ ID NO: 78918
  Payload ID: 15727
  Gene Symbol: NEU1
  Gene Name: sialidase 1 (lysosomal sialidase)
  ENSP ID: ENSP00000432513

SEQ ID NO: 78921 - protein, 72 aa, Homo sapiens
  Payload ID: 15727
  Gene Symbol: NEU1
  Gene Name: sialidase 1 (lysosomal sialidase)
  ENSP ID: ENSP00000432761
MTGERPSTALPDRRWGPRILGFWGGCRVWVFAAIFLLLSLAASWSKAENDFGLAAHGLLQRSLSMMGMSPMG

SEQ ID NO: 78922 - protein, 267 aa, Homo sapiens; identical to SEQ ID NO: 78918
  Payload ID: 15727
  Gene Symbol: NEU1
  Gene Name: sialidase 1 (lysosomal sialidase)
  ENSP ID: ENSP00000432824

SEQ ID NO: 78923 - protein, 72 aa, Homo sapiens; identical to SEQ ID NO: 78921
  Payload ID: 15727
  Gene Symbol: NEU1
  Gene Name: sialidase 1 (lysosomal sialidase)
  ENSP ID: ENSP00000432864

SEQ ID NO: 78924 - protein, 72 aa, Homo sapiens; identical to SEQ ID NO: 78921
  Payload ID: 15727
  Gene Symbol: NEU1
  Gene Name: sialidase 1 (lysosomal sialidase)
  ENSP ID: ENSP00000432995

SEQ ID NO: 78925 - protein, 267 aa, Homo sapiens; identical to SEQ ID NO: 78918
  Payload ID: 15727
  Gene Symbol: NEU1
  Gene Name: sialidase 1 (lysosomal sialidase)
  ENSP ID: ENSP00000433127

SEQ ID NO: 78926 - protein, 267 aa, Homo sapiens; identical to SEQ ID NO: 78918
  Payload ID: 15727
  Gene Symbol: NEU1
  Gene Name: sialidase 1 (lysosomal sialidase)
  ENSP ID: ENSP00000433185

SEQ ID NO: 78927 - protein, 267 aa, Homo sapiens; identical to SEQ ID NO: 78918
  Payload ID: 15727
  Gene Symbol: NEU1
  Gene Name: sialidase 1 (lysosomal sialidase)
  ENSP ID: ENSP00000433943

SEQ ID NO: 78928 - protein, 72 aa, Homo sapiens; identical to SEQ ID NO: 78921
  Payload ID: 15727
  Gene Symbol: NEU1
  Gene Name: sialidase 1 (lysosomal sialidase)
  ENSP ID: ENSP00000434436

SEQ ID NO: 78929 - protein, 72 aa, Homo sapiens; identical to SEQ ID NO: 78921
  Payload ID: 15727
  Gene Symbol: NEU1
  Gene Name: sialidase 1 (lysosomal sialidase)
  ENSP ID: ENSP00000435525

SEQ ID NO: 78930 - protein, 72 aa, Homo sapiens; identical to SEQ ID NO: 78921
  Payload ID: 15727
  Gene Symbol: NEU1
  Gene Name: sialidase 1 (lysosomal sialidase)
  ENSP ID: ENSP00000435814

SEQ ID NO: 78931 - protein, 72 aa, Homo sapiens; identical to SEQ ID NO: 78921
  Payload ID: 15727
  Gene Symbol: NEU1
  Gene Name: sialidase 1 (lysosomal sialidase)
  ENSP ID: ENSP00000436207

SEQ ID NO: 78932 - protein, 267 aa, Homo sapiens; identical to SEQ ID NO: 78918
  Payload ID: 15727
  Gene Symbol: NEU1
  Gene Name: sialidase 1 (lysosomal sialidase)
  ENSP ID: ENSP00000436889

SEQ ID NO: 78933 - protein, 380 aa, Homo sapiens
  Payload ID: 15728
  Gene Symbol: NEU2
  Gene Name: sialidase 2 (cytosolic sialidase)
  Uniprot ID: Q9Y3R4
  ENSP ID: ENSP00000233840
MASLPVLQKESVFQSGAHAYRIPALLYLPGQQSLLAFAEQRASKKDEHAELIVLRRGDYDAPTHQVQWQAQEVVAQARLDGHRSMNPCPLYDAQTGTLFLFFIAIPGQVTEQQQLQTRANVTRLCQVTSTDHGRTWSSPRDLTDAAIGPAYREWSTFAVGPGHCLQLHDRARSLVVPAYAYRKLHPIQRPIPSAFCFLSHDHGRTWARGHFVAQDTLECQVAEVETGEQRVVTLNARSHLRARVQAQSTNDGLDFQESQLVKKLVEPPPQGCQGSVISFPSPRSGPGSPAQWLLYTHPTHSWQRADLGAYLNPRPPAPEAWSEPVLLAKGSCAYSDLQSMGTGPDGSPLFGCLYEANDYEEIVFLMFTLKQAFPAEYLPQ

SEQ ID NO: 78934 - protein, 461 aa, Homo sapiens
  Payload ID: 15729
  Gene Symbol: NEU3
  Gene Name: sialidase 3 (membrane sialidase)
  Uniprot ID: Q9UQ49
  ENSP ID: ENSP00000294064
MRPADLPPRPMEESPASSSAPTETEEPGSSAEVMEEVTTCSFNSPLFRQEDDRGITYRIPALLYIPPTHTFLAFAEKRSTRRDEDALHLVLRRGLRIGQLVQWGPLKPLMEATLPGHRTMNPCPVWEQKSGCVFLFFICVRGHVTERQQIVSGRNAARLCFIYSQDAGCSWSEVRDLTEEVIGSELKHWATFAVGPGHGIQLQSGRLVIPAYTYYIPSWFFCFQLPCKTRPHSLMIYSDDLGVTWHHGRLIRPMVTVECEVAEVTGRAGHPVLYCSARTPNRCRAEALSTDHGEGFQRLALSRQLCEPPHGCQGSVVSFRPLEIPHRCQDSSSKDAPTIQQSSPGSSLRLEEEAGTPSESWLLYSHPTSRKQRVDLGIYLNQTPLEAACWSRPWILHCGPCGYSDLAALEEEGLFGCLFECGTKQECEQIAFRLFTHREILSHLQGDCTSPGRNPSQFKSN

SEQ ID NO: 78935 - protein, 461 aa, Homo sapiens; identical to SEQ ID NO: 78934
  Payload ID: 15729
  Gene Symbol: NEU3
  Gene Name: sialidase 3 (membrane sialidase)
  Uniprot ID: Q9UQ49
  ENSP ID: ENSP00000432097

SEQ ID NO: 78936 - protein, 101 aa, Homo sapiens
  Payload ID: 15729
  Gene Symbol: NEU3
  Gene Name: sialidase 3 (membrane sialidase)
  ENSP ID: ENSP00000434474
MRPADLPPRPMEESPASSSAPTETEEPGSSAVGAPEATDGSHTTGASDHEPLSCMGAEEWLCVPVLHLCAGPCHRASTDCVRQECCPPLLHLQSGCWMFME

SEQ ID NO: 78937 - protein, 170 aa, Homo sapiens
  Payload ID: 15729
  Gene Symbol: NEU3
  Gene Name: sialidase 3 (membrane sialidase)
  ENSP ID: ENSP00000434754
MRPADLPPRPMEESPASSSAPTETEEPGSSAEVMEEVTTCSFNSPLFRQEDDRGITYRIPALLYIPPTHTFLAFAEKRSTRRDEDALHLVLRRGLRIGQLVQVTLHPRSESGPQFLFTKLRALQDLCLFSSVQESPVWGAEAEKTAKTMALTECLLCARGTLGPHSHSVS

SEQ ID NO: 78938 - protein, 101 aa, Homo sapiens; identical to SEQ ID NO: 78936
  Payload ID: 15729
  Gene Symbol: NEU3
  Gene Name: sialidase 3 (membrane sialidase)
  ENSP ID: ENSP00000434907

SEQ ID NO: 78939 - protein, 139 aa, Homo sapiens
  Payload ID: 15729
  Gene Symbol: NEU3
  Gene Name: sialidase 3 (membrane sialidase)
  ENSP ID: ENSP00000436118
MRPADLPPRPMEESPASSSAPTETEEPGSSAEVMEEVTTCSFNSPLFRQEDDRGITYRIPALLYIPPTHTFLAFAEKRSTRRDEDALHLVLRRGLRIGQLVQRWGFAMLPRLVSNSWTQAILKCWDYSMSHCAWPFGGP

SEQ ID NO: 78940 - protein, 58 aa, Homo sapiens
  Payload ID: 15729
  Gene Symbol: NEU3
  Gene Name: sialidase 3 (membrane sialidase)
  ENSP ID: ENSP00000436540
MRPADLPPRPMEESPASSSAPTETEEPGSSAAPDLCETFWVAMPESPSILLLSSTRSA

SEQ ID NO: 78941 - protein, 497 aa, Homo sapiens
  Payload ID: 15730
  Gene Symbol: NEU4
  Gene Name: sialidase 4
  Uniprot ID: Q8WWR8
  ENSP ID: ENSP00000320318
MMSSAAFPRWLQSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 78942 - protein, 484 aa, Homo sapiens
  Payload ID: 15730
  Gene Symbol: NEU4
  Gene Name: sialidase 4
  Uniprot ID: Q8WWR8
  ENSP ID: ENSP00000375830
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 78943 - protein, 484 aa, Homo sapiens; identical to SEQ ID NO: 78942
  Payload ID: 15730
  Gene Symbol: NEU4
  Gene Name: sialidase 4
  Uniprot ID: Q8WWR8
  ENSP ID: ENSP00000384804

SEQ ID NO: 78944 - protein, 496 aa, Homo sapiens
  Payload ID: 15730
  Gene Symbol: NEU4
  Gene Name: sialidase 4
  Uniprot ID: Q8WWR8
  ENSP ID: ENSP00000385149
MMSSAAFPRWLSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 78945 - protein, 484 aa, Homo sapiens; identical to SEQ ID NO: 78942
  Payload ID: 15730
  Gene Symbol: NEU4
  Gene Name: sialidase 4
  Uniprot ID: Q8WWR8
  ENSP ID: ENSP00000385402

SEQ ID NO: 78946 - protein, 260 aa, Homo sapiens
  Payload ID: 15730
  Gene Symbol: NEU4
  Gene Name: sialidase 4
  ENSP ID: ENSP00000388707
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSF

SEQ ID NO: 78947 - protein, 158 aa, Homo sapiens
  Payload ID: 15730
  Gene Symbol: NEU4
  Gene Name: sialidase 4
  ENSP ID: ENSP00000394769
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQEEKAGR

SEQ ID NO: 78948 - protein, 144 aa, Homo sapiens
  Payload ID: 15730
  Gene Symbol: NEU4
  Gene Name: sialidase 4
  ENSP ID: ENSP00000396197
MTSCWANSGMTLCPGHMAGRVPGALWPASPAPWHQPAWPRSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFI

SEQ ID NO: 78949 - protein, 214 aa, Homo sapiens
  Payload ID: 15730
  Gene Symbol: NEU4
  Gene Name: sialidase 4
  ENSP ID: ENSP00000397167
MGVPRTPSRTVLFERERTGLTYRVPSLLPVPPGPTLLAFVEQRLSPDDSHAHRLVLRRGTLAGGSVRTGPHSLWVPATVCSCPQAACWYPPTPTAWTAESVLARSAGPALTPSPSTAMTTAAPGAVEASCPTCAQASASWQRWTVGRPAASSTAMPGAHWAAVCRRSALTRAPPSCPQSAWLPCPRLPGAARAASWASQPPPPTGHGMTVGQWA

SEQ ID NO: 78950 - protein, 188 aa, Homo sapiens
  Payload ID: 15730
  Gene Symbol: NEU4
  Gene Name: sialidase 4
  ENSP ID: ENSP00000397860
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFG

SEQ ID NO: 78951 - protein, 77 aa, Homo sapiens
  Payload ID: 15730
  Gene Symbol: NEU4
  Gene Name: sialidase 4
  ENSP ID: ENSP00000398571
MGVPRTPSRTVLFERERTGLTYRVPSLLPVPPGPTLLAFVEQRLSPDDSHAHRLVLRRGTLAGGSVRWGALHVLGTA

SEQ ID NO: 78952 - protein, 214 aa, Homo sapiens
  Payload ID: 15730
  Gene Symbol: NEU4
  Gene Name: sialidase 4
  ENSP ID: ENSP00000406678
MMSSAAFPRWLSMGVPRTPSRTVLFERERTGLTYRVPSLLPVPPGPTLLAFVEQRLSPDDSHAHRLVLRRGTLAGGSVRTGPHSLWVPATVCSCPQAACWYPPTPTAWTAESVLARSAGPALTPSPSTAMTTAAPGAVEASCPTCAQASASWQRWTVGRPAASSTAMPGAHWAAVCRRSALTRAPPSCPQSAWLPCPRLPGAARAASWASQPPP

SEQ ID NO: 78953 - protein, 52 aa, Homo sapiens
  Payload ID: 15730
  Gene Symbol: NEU4
  Gene Name: sialidase 4
  ENSP ID: ENSP00000412688
MPPHPGPALVGVAWEQTPRMAAGPHSALELLIPVGASQSMGVPRTPSRTVLF

SEQ ID NO: 78954 - protein, 484 aa, Homo sapiens; identical to SEQ ID NO: 78942
  Payload ID: 15730
  Gene Symbol: NEU4
  Gene Name: sialidase 4
  Uniprot ID: Q8WWR8
  ENSP ID: ENSP00000478409

SEQ ID NO: 78955 - protein, 496 aa, Homo sapiens; identical to SEQ ID NO: 78944
  Payload ID: 15730
  Gene Symbol: NEU4
  Gene Name: sialidase 4
  Uniprot ID: Q8WWR8
  ENSP ID: ENSP00000482722

SEQ ID NO: 78956 - protein, 484 aa, Homo sapiens; identical to SEQ ID NO: 78942
  Payload ID: 15730
  Gene Symbol: NEU4
  Gene Name: sialidase 4
  Uniprot ID: Q8WWR8
  ENSP ID: ENSP00000483726

SEQ ID NO: 78957 - protein, 497 aa, Homo sapiens; identical to SEQ ID NO: 78941
  Payload ID: 15730
  Gene Symbol: NEU4
  Gene Name: sialidase 4
  Uniprot ID: Q8WWR8
  ENSP ID: ENSP00000485701

SEQ ID NO: 78958 - protein, 188 aa, Homo sapiens; identical to SEQ ID NO: 78950
  Payload ID: 15730
  Gene Symbol: NEU4
  Gene Name: sialidase 4
  ENSP ID: ENSP00000485788

SEQ ID NO: 78959 - protein, 214 aa, Homo sapiens; identical to SEQ ID NO: 78952
  Payload ID: 15730
  Gene Symbol: NEU4
  Gene Name: sialidase 4
  ENSP ID: ENSP00000485934

SEQ ID NO: 78960 - protein, 144 aa, Homo sapiens; identical to SEQ ID NO: 78948
  Payload ID: 15730
  Gene Symbol: NEU4
  Gene Name: sialidase 4
  ENSP ID: ENSP00000485992

SEQ ID NO: 78961 - protein, 52 aa, Homo sapiens; identical to SEQ ID NO: 78953
  Payload ID: 15730
  Gene Symbol: NEU4
  Gene Name: sialidase 4
  ENSP ID: ENSP00000486118

SEQ ID NO: 78962 - protein, 214 aa, Homo sapiens; identical to SEQ ID NO: 78949
  Payload ID: 15730
  Gene Symbol: NEU4
  Gene Name: sialidase 4
  ENSP ID: ENSP00000486591

SEQ ID NO: 78963 - protein, 484 aa, Homo sapiens; identical to SEQ ID NO: 78942
  Payload ID: 15730
  Gene Symbol: NEU4
  Gene Name: sialidase 4
  Uniprot ID: Q8WWR8
  ENSP ID: ENSP00000486602

SEQ ID NO: 78964 - protein, 260 aa, Homo sapiens; identical to SEQ ID NO: 78946
  Payload ID: 15730
  Gene Symbol: NEU4
  Gene Name: sialidase 4
  ENSP ID: ENSP00000487103

SEQ ID NO: 78965 - protein, 158 aa, Homo sapiens; identical to SEQ ID NO: 78947
  Payload ID: 15730
  Gene Symbol: NEU4
  Gene Name: sialidase 4
  ENSP ID: ENSP00000487192

SEQ ID NO: 78966 - protein, 77 aa, Homo sapiens; identical to SEQ ID NO: 78951
  Payload ID: 15730
  Gene Symbol: NEU4
  Gene Name: sialidase 4
  ENSP ID: ENSP00000487199

SEQ ID NO: 78967 - protein, 400 aa, Homo sapiens
  Payload ID: 15731
  Gene Symbol: SPN
  Gene Name: sialophorin
  Uniprot ID: P16150
  ENSP ID: ENSP00000353238
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGSLAMEELKSGSGPSLKGEEEPLVASEDGAVDAPAPDEPEGGDGAAP

SEQ ID NO: 78968 - protein, 400 aa, Homo sapiens; identical to SEQ ID NO: 78967
  Payload ID: 15731
  Gene Symbol: SPN
  Gene Name: sialophorin
  Uniprot ID: P16150
  ENSP ID: ENSP00000378787

SEQ ID NO: 78969 - protein, 355 aa, Homo sapiens
  Payload ID: 15731
  Gene Symbol: SPN
  Gene Name: sialophorin
  ENSP ID: ENSP00000412907
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGS

SEQ ID NO: 78970 - protein, 400 aa, Homo sapiens; identical to SEQ ID NO: 78967
  Payload ID: 15731
  Gene Symbol: SPN
  Gene Name: sialophorin
  Uniprot ID: P16150
  ENSP ID: ENSP00000455266

SEQ ID NO: 78971 - protein, 827 aa, Homo sapiens
  Payload ID: 15732
  Gene Symbol: SIDT1
  Gene Name: SID1 transmembrane family, member 1
  Uniprot ID: Q9NXL6
  ENSP ID: ENSP00000264852
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFQFDTSFMYMIAGLCMLKLYQTRHPDINASAYSAYASFAVVIMVTVLGVVFGKNDVWFWVIFSAIHVLASLALSTQIYYMGRFKIDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 78972 - protein, 832 aa, Homo sapiens
  Payload ID: 15732
  Gene Symbol: SIDT1
  Gene Name: SID1 transmembrane family, member 1
  Uniprot ID: Q9NXL6
  ENSP ID: ENSP00000377416
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFQFDTSFMYMIAGLCMLKLYQTRHPDINASAYSAYASFAVVIMVTVLGVVFGKNDVWFWVIFSAIHVLASLALSTQIYYMGRFKIDVSDTDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 78973 - protein, 855 aa, Homo sapiens
  Payload ID: 15733
  Gene Symbol: SIDT2
  Gene Name: SID1 transmembrane family, member 2
  ENSP ID: ENSP00000278951
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGHDQFKRRLPSGQMRQLCIAMGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVSGPPGRAGWVREGSSCLLLCG

SEQ ID NO: 78974 - protein, 832 aa, Homo sapiens
  Payload ID: 15733
  Gene Symbol: SIDT2
  Gene Name: SID1 transmembrane family, member 2
  Uniprot ID: Q8NBJ9
  ENSP ID: ENSP00000314023
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 78975 - protein, 829 aa, Homo sapiens
  Payload ID: 15733
  Gene Symbol: SIDT2
  Gene Name: SID1 transmembrane family, member 2
  ENSP ID: ENSP00000399635
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESASLLGHPRVLADSFPGSSPYEGYNYGSFENVSGSTDGLVDSAGTGDLSYGYQGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 78976 - protein, 110 aa, Homo sapiens
  Payload ID: 15733
  Gene Symbol: SIDT2
  Gene Name: SID1 transmembrane family, member 2
  ENSP ID: ENSP00000431176
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQ

SEQ ID NO: 78977 - protein, 124 aa, Homo sapiens
  Payload ID: 15733
  Gene Symbol: SIDT2
  Gene Name: SID1 transmembrane family, member 2
  ENSP ID: ENSP00000432432
MRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 78978 - protein, 97 aa, Homo sapiens
  Payload ID: 15733
  Gene Symbol: SIDT2
  Gene Name: SID1 transmembrane family, member 2
  ENSP ID: ENSP00000435004
MFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCS

SEQ ID NO: 78979 - protein, 133 aa, Homo sapiens
  Payload ID: 15733
  Gene Symbol: SIDT2
  Gene Name: SID1 transmembrane family, member 2
  ENSP ID: ENSP00000435890
GIFRRILHVLYTDCIRQCSGPLYVDRMVLLVMGNVINWSLAAYGLIMRPNDFASYLLAIGICNLLLYFAFYIIMKKTPAESREHNRDCILLDFFDDHDIWHFLSSIAMFGSFLVLLTLDDDLDTVQRDKIYVF

SEQ ID NO: 78980 - protein, 170 aa, Homo sapiens
  Payload ID: 15733
  Gene Symbol: SIDT2
  Gene Name: SID1 transmembrane family, member 2
  ENSP ID: ENSP00000436983
MDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENW

SEQ ID NO: 78981 - protein, 832 aa, Homo sapiens; identical to SEQ ID NO: 78974
  Payload ID: 15733
  Gene Symbol: SIDT2
  Gene Name: SID1 transmembrane family, member 2
  Uniprot ID: Q8NBJ9
  ENSP ID: ENSP00000482762

SEQ ID NO: 78982 - protein, 855 aa, Homo sapiens; identical to SEQ ID NO: 78973
  Payload ID: 15733
  Gene Symbol: SIDT2
  Gene Name: SID1 transmembrane family, member 2
  ENSP ID: ENSP00000486114

SEQ ID NO: 78983 - protein, 2193 aa, Homo sapiens
  Payload ID: 15734
  Gene Symbol: SDK1
  Gene Name: sidekick cell adhesion molecule 1
  ENSP ID: ENSP00000374182
MARGARPSAAGGGGGGAEPPERAGPGRPRGSPPGRARPSLAPRPGPEPSRPRAAPETSGGDTAGAGRCGGRRAAKLGPGRRGWWALLALQLHLLRALAQDDVAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTDLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 78984 - protein, 2213 aa, Homo sapiens
  Payload ID: 15734
  Gene Symbol: SDK1
  Gene Name: sidekick cell adhesion molecule 1
  Uniprot ID: Q7Z5N4
  ENSP ID: ENSP00000385899
MARGARPSAAGGGGGGAEPPERAGPGRPRGSPPGRARPSLAPRPGPEPSRPRAAPETSGGDTAGAGRCGGRRAAKLGPGRRGWWALLALQLHLLRALAQDDVAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTAQSSFKTVNSSSTSTMCELTHLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 78985 - protein, 107 aa, Homo sapiens
  Payload ID: 15734
  Gene Symbol: SDK1
  Gene Name: sidekick cell adhesion molecule 1
  ENSP ID: ENSP00000404118
  MOD_RES (1)..(1): Any amino acid
XGDVGTPETMAPTIVVPPGNRSVVAGSSETTLECIASARPVEDLSVTWKRNGVRITSGLHSFGRRLTISNPTSADTGPYVCEAALPGSAFEPARATAFLFIIGPTLF

SEQ ID NO: 78986 - protein, 2213 aa, Homo sapiens
  Payload ID: 15734
  Gene Symbol: SDK1
  Gene Name: sidekick cell adhesion molecule 1
  ENSP ID: ENSP00000478062
MARGARPSAAGGGGGGAEPPERAGPGRPRGSPPGRARPSLAPRPGPEPSRPRAAPETSGGDTAGAGRCGGRRAAKLGPGRRGWWALLALQLHLLRALAQGRCAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTAQSSFKTVNSSSTSTMCELTHLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 78987 - protein, 2172 aa, Homo sapiens
  Payload ID: 15735
  Gene Symbol: SDK2
  Gene Name: sidekick cell adhesion molecule 2
  Uniprot ID: Q58EX2
  ENSP ID: ENSP00000376421
MWGLLIWTLLALHQIRAARAQDDVSPYFKTEPVRTQVHLEGNRLVLTCMAEGSWPLEFKWLHNNRELTKFSLEYRYMITSLDRTHAGFYRCIVRNRMGALLQRQTEVQVAYMGSFEEGEKHQSVSHGEAAVIRAPRIASFPQPQVTWFRDGRKIPPSSRIAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 78988 - protein, 1329 aa, Homo sapiens
  Payload ID: 15735
  Gene Symbol: SDK2
  Gene Name: sidekick cell adhesion molecule 2
  ENSP ID: ENSP00000407098
QGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTYLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 78989 - protein, 322 aa, Homo sapiens
  Payload ID: 15736
  Gene Symbol: SFXN1
  Gene Name: sideroflexin 1
  Uniprot ID: Q9H9B4
  ENSP ID: ENSP00000316905
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIMNTLEKKAFLKRFPWMSAPIQVGLVGFCLVFATPLCCALFPQKSSMSVTSLEAELQAKIQESHPELRRVYFNKGL

SEQ ID NO: 78990 - protein, 144 aa, Homo sapiens
  Payload ID: 15736
  Gene Symbol: SFXN1
  Gene Name: sideroflexin 1
  ENSP ID: ENSP00000420961
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTV

SEQ ID NO: 78991 - protein, 193 aa, Homo sapiens
  Payload ID: 15736
  Gene Symbol: SFXN1
  Gene Name: sideroflexin 1
  ENSP ID: ENSP00000421467
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINI

SEQ ID NO: 78992 - protein, 56 aa, Homo sapiens
  Payload ID: 15736
  Gene Symbol: SFXN1
  Gene Name: sideroflexin 1
  ENSP ID: ENSP00000421982
MSGELPPNINIKEPRWDQSTFIGRANHFFTVTDPRNILLTNEQLESARKIVHDYRK

SEQ ID NO: 78993 - protein, 22 aa, Homo sapiens
  Payload ID: 15736
  Gene Symbol: SFXN1
  Gene Name: sideroflexin 1
  ENSP ID: ENSP00000424270
  MOD_RES (1)..(1): Any amino acid
XNILLTNEQLESARKIVHDYRK

SEQ ID NO: 78994 - protein, 177 aa, Homo sapiens
  Payload ID: 15736
  Gene Symbol: SFXN1
  Gene Name: sideroflexin 1
  ENSP ID: ENSP00000473710
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKVLRFLFP

SEQ ID NO: 78995 - protein, 322 aa, Homo sapiens
  Payload ID: 15737
  Gene Symbol: SFXN2
  Gene Name: sideroflexin 2
  Uniprot ID: Q96NB2
  ENSP ID: ENSP00000358909
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNMLTKKAPPLVGRWVPFAAVAAANCVNIPMMRQQELIKGICVKDRNENEIGHSRRAAAIGITQVVISRITMSAPGMILLPVIMERLEKLHFMQKVKVLHAPLQVMLSGCFLIFMVPVACGLFPQKCELPVSYLEPKLQDTIKAKYGELEPYVYFNKGL

SEQ ID NO: 78996 - protein, 112 aa, Homo sapiens
  Payload ID: 15737
  Gene Symbol: SFXN2
  Gene Name: sideroflexin 2
  ENSP ID: ENSP00000473316
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYSY

SEQ ID NO: 78997 - protein, 186 aa, Homo sapiens
  Payload ID: 15737
  Gene Symbol: SFXN2
  Gene Name: sideroflexin 2
  ENSP ID: ENSP00000473325
MMYPVRGTEGSTVLCVSKMEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRKRRPWWAAGCPLPLWLRLTVSISP

SEQ ID NO: 78998 - protein, 67 aa, Homo sapiens
  Payload ID: 15737
  Gene Symbol: SFXN2
  Gene Name: sideroflexin 2
  ENSP ID: ENSP00000473329
MEADLSGFNIDAPRWDQRTFLGRVKHFLNITDPRTVFVSERELDWAKDGGCAPRHPSGAAAVCQEAV

SEQ ID NO: 78999 - protein, 168 aa, Homo sapiens
  Payload ID: 15737
  Gene Symbol: SFXN2
  Gene Name: sideroflexin 2
  ENSP ID: ENSP00000473374
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNMLT

SEQ ID NO: 79000 - protein, 19 aa, Homo sapiens
  Payload ID: 15737
  Gene Symbol: SFXN2
  Gene Name: sideroflexin 2
  ENSP ID: ENSP00000473392
MHFRSTVLCVSKMEADLSG

SEQ ID NO: 79001 - protein, 153 aa, Homo sapiens
  Payload ID: 15737
  Gene Symbol: SFXN2
  Gene Name: sideroflexin 2
  ENSP ID: ENSP00000473504
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVSLAASHHGKA

SEQ ID NO: 79002 - protein, 135 aa, Homo sapiens
  Payload ID: 15737
  Gene Symbol: SFXN2
  Gene Name: sideroflexin 2
  ENSP ID: ENSP00000473518
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNR

SEQ ID NO: 79003 - protein, 167 aa, Homo sapiens
  Payload ID: 15737
  Gene Symbol: SFXN2
  Gene Name: sideroflexin 2
  ENSP ID: ENSP00000473573
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNML

SEQ ID NO: 79004 - protein, 138 aa, Homo sapiens
  Payload ID: 15737
  Gene Symbol: SFXN2
  Gene Name: sideroflexin 2
  ENSP ID: ENSP00000473578
MSTVLCVSKMEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNAL

SEQ ID NO: 79005 - protein, 325 aa, Homo sapiens
  Payload ID: 15738
  Gene Symbol: SFXN3
  Gene Name: sideroflexin 3
  Uniprot ID: Q9BWM7
  ENSP ID: ENSP00000224807
MESKMGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKHLPPLVGRFVPFAAVAAANCINIPLMRQRELQVGIPVADEAGQRLGYSVTAAKQGIFQVVISRICMAIPAMAIPPLIMDTLEKKDFLKRRPWLGAPLQVGLVGFCLVFATPLCCALFPQKSSIHISNLEPELRAQIHEQNPSVEVVYYNKGL

SEQ ID NO: 79006 - protein, 321 aa, Homo sapiens
  Payload ID: 15738
  Gene Symbol: SFXN3
  Gene Name: sideroflexin 3
  ENSP ID: ENSP00000377103
MGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKHLPPLVGRFVPFAAVAAANCINIPLMRQRELQVGIPVADEAGQRLGYSVTAAKQGIFQVVISRICMAIPAMAIPPLIMDTLEKKDFLKRRPWLGAPLQVGLVGFCLVFATPLCCALFPQKSSIHISNLEPELRAQIHEQNPSVEVVYYNKGL

SEQ ID NO: 79007 - protein, 177 aa, Homo sapiens
  Payload ID: 15738
  Gene Symbol: SFXN3
  Gene Name: sideroflexin 3
  ENSP ID: ENSP00000474564
MGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKSPSPPHGP

SEQ ID NO: 79008 - protein, 337 aa, Homo sapiens
  Payload ID: 15739
  Gene Symbol: SFXN4
  Gene Name: sideroflexin 4
  Uniprot ID: Q6P4A7
  ENSP ID: ENSP00000347924
MSLEQEEETQPGRLLGRRDAVPAFIEPNVRFWITERQSFIRRFLQWTELLDPTNVFISVESIENSRQLLCTNEDVSSPASADQRIQEAWKRSLATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 79009 - protein, 178 aa, Homo sapiens
  Payload ID: 15739
  Gene Symbol: SFXN4
  Gene Name: sideroflexin 4
  ENSP ID: ENSP00000358127
MAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVL

SEQ ID NO: 79010 - protein, 62 aa, Homo sapiens
  Payload ID: 15739
  Gene Symbol: SFXN4
  Gene Name: sideroflexin 4
  ENSP ID: ENSP00000414193
MAPTVFLSMTPLKGIKSVILPQVFLCAYMAAFNSINGNRSYTCKPLERSLLMAGAVASSTFL

SEQ ID NO: 79011 - protein, 340 aa, Homo sapiens
  Payload ID: 15740
  Gene Symbol: SFXN5
  Gene Name: sideroflexin 5
  Uniprot ID: Q8TD22
  ENSP ID: ENSP00000272433
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKTALLQARPRLLLPVQSLVCLAAFGLALPLAISLFPQMSEIETSQLEPEIAQATSSRTVVYNKGL

SEQ ID NO: 79012 - protein, 253 aa, Homo sapiens
  Payload ID: 15740
  Gene Symbol: SFXN5
  Gene Name: sideroflexin 5
  ENSP ID: ENSP00000387076
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVGRLSCRHAPGCSSLCKASCAWQPSAWPCRWPSASSRKCQRLKHPN

SEQ ID NO: 79013 - protein, 156 aa, Homo sapiens
  Payload ID: 15740
  Gene Symbol: SFXN5
  Gene Name: sideroflexin 5
  ENSP ID: ENSP00000396825
MADTATTASAAAASAASASSDAPPFQLGKPRFQQTSFYGRFRHFLDIIDPRTLFVTERRLREAVQLLEDYKHGTLRPGVTNEQLWSAQKIKQVIFLLGRQFRSSLAQPDTGIHCLLWLNQSHNACVNYANRNATKPSPASKFIQGYLGAVISAVSI

SEQ ID NO: 79014 - protein, 88 aa, Homo sapiens
  Payload ID: 15740
  Gene Symbol: SFXN5
  Gene Name: sideroflexin 5
  ENSP ID: ENSP00000398580
MADTATTASAAAASAASASSDAPPFQLGKPRFQQTSFYGRFRHFLDIIDPRTLFVTEMESCTVPQAHCNPCLLGSETSQRGCAAAGGL

SEQ ID NO: 79015 - protein, 252 aa, Homo sapiens
  Payload ID: 15740
  Gene Symbol: SFXN5
  Gene Name: sideroflexin 5
  ENSP ID: ENSP00000402141
  MOD_RES (1)..(1): Any amino acid
XAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVGPAGDGADASGPAHAHPGATPDRHVHAGEIETSQLEPEIAQATSSRTVVYNKGL

SEQ ID NO: 79016 - protein, 197 aa, Homo sapiens
  Payload ID: 15741
  Gene Symbol: SIGLECL1
  Gene Name: SIGLEC family like 1
  Uniprot ID: Q8N7X8
  ENSP ID: ENSP00000321249
MLPLLQLVPAKLLNSSCSLEKTLQCSCSFHGIPTPSVQWWMGGVPVGVDGMDGSLQVTSTMLGPWANSTISLTEEPEMGMRLLCEGKNQNGTHALSILLMSRKSSLAAQAFVKGLIQGAIYAGIVIALLFLCLLPLIVKHIRKKQAKKAAAIRAKKSSKVRASQELEMSLKPEEPGKPVVATFSESRILEKQDKRAS

SEQ ID NO: 79017 - protein, 140 aa, Homo sapiens
  Payload ID: 15741
  Gene Symbol: SIGLECL1
  Gene Name: SIGLEC family like 1
  ENSP ID: ENSP00000469589
MLPLLQLVPAKLLNSSCSLEKTLQCSCSFHGIPTPSVQWWMGGVPVGVDGMDGSLQVTSTMLGPWANSTISLTEEPEMGMRLLCEGKNQNGTHALSILLMSRKSSLAAQAFVKGLIQGAIYAGIVIALLFLCLLPLIVKH

SEQ ID NO: 79018 - protein, 84 aa, Homo sapiens
  Payload ID: 15741
  Gene Symbol: SIGLECL1
  Gene Name: SIGLEC family like 1
  ENSP ID: ENSP00000469601
MLPLLQLVPAKLLNSSCSLEKTLQCSCSFHGIPTPSVQWWMGGVPVGVDGMDGSLQVTSTMLGPWANSTISLTEEPEMGMRLLC

SEQ ID NO: 79019 - protein, 13 aa, Homo sapiens
  Payload ID: 15741
  Gene Symbol: SIGLECL1
  Gene Name: SIGLEC family like 1
  ENSP ID: ENSP00000472701
MLPLLQLGGKDNS

SEQ ID NO: 79020 - protein, 103 aa, Homo sapiens
  Payload ID: 15741
  Gene Symbol: SIGLECL1
  Gene Name: SIGLEC family like 1
  ENSP ID: ENSP00000472702
MLPLLQLGKSSLAAQAFVKGLIQGAIYAGIVIALLFLCLLPLIVKHIRKKQAKKAAAIRAKKSSKVRASQELEMSLKPEEPGKPVVATFSESRILEKQDKRAS

SEQ ID NO: 79021 - protein, 197 aa, Homo sapiens; identical to SEQ ID NO: 79016
  Payload ID: 15741
  Gene Symbol: SIGLECL1
  Gene Name: SIGLEC family like 1
  Uniprot ID: Q8N7X8
  ENSP ID: ENSP00000480286

SEQ ID NO: 79022 - protein, 223 aa, Homo sapiens
  Payload ID: 15742
  Gene Symbol: SIGMAR1
  Gene Name: sigma non-opioid intracellular receptor 1
  Uniprot ID: Q99720
  ENSP ID: ENSP00000277010
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 79023 - protein, 134 aa, Homo sapiens
  Payload ID: 15742
  Gene Symbol: SIGMAR1
  Gene Name: sigma non-opioid intracellular receptor 1
  ENSP ID: ENSP00000368170
MGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 79024 - protein, 192 aa, Homo sapiens
  Payload ID: 15742
  Gene Symbol: SIGMAR1
  Gene Name: sigma non-opioid intracellular receptor 1
  Uniprot ID: Q99720
  ENSP ID: ENSP00000420022
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGETVVHGPGEATAVEWGPNTWMVEYGRGVIPSTLAFALADTVFSTQDFLTLFYTLRSYARGLRLELTTYLFGQDP

SEQ ID NO: 79025 - protein, 106 aa, Homo sapiens
  Payload ID: 15742
  Gene Symbol: SIGMAR1
  Gene Name: sigma non-opioid intracellular receptor 1
  Uniprot ID: Q99720
  ENSP ID: ENSP00000434453
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEALLG

SEQ ID NO: 79026 - protein, 169 aa, Homo sapiens
  Payload ID: 15743
  Gene Symbol: SPCS1
  Gene Name: signal peptidase complex subunit 1
  ENSP ID: ENSP00000233025
MARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAIVGFIYGYVAEQFGWTVYIVMAGFAFSCLLTLPPWPIYRRHPLKWLPVQESSTDDKKPGERKIKRHAKNN

SEQ ID NO: 79027 - protein, 80 aa, Homo sapiens
  Payload ID: 15743
  Gene Symbol: SPCS1
  Gene Name: signal peptidase complex subunit 1
  ENSP ID: ENSP00000391610
MFQGIILFSAIVGFIYGYVAEQFGWTVYIVMAGFAFSCLLTLPPWPIYRRHPLKWLPVQESSTDDKKPGERKIKRHAKNN

SEQ ID NO: 79028 - protein, 102 aa, Homo sapiens
  Payload ID: 15743
  Gene Symbol: SPCS1
  Gene Name: signal peptidase complex subunit 1
  Uniprot ID: Q9Y6A9
  ENSP ID: ENSP00000473265
MLEHLSSLPTQMDYKGQKLAEQMFQGIILFSAIVGFIYGYVAEQFGWTVYIVMAGFAFSCLLTLPPWPIYRRHPLKWLPVQESSTDDKKPGERKIKRHAKNN

SEQ ID NO: 79029 - protein, 169 aa, Homo sapiens; identical to SEQ ID NO: 79026
  Payload ID: 15743
  Gene Symbol: SPCS1
  Gene Name: signal peptidase complex subunit 1
  ENSP ID: ENSP00000478310

SEQ ID NO: 79030 - protein, 226 aa, Homo sapiens
  Payload ID: 15744
  Gene Symbol: SPCS2
  Gene Name: signal peptidase complex subunit 2
  Uniprot ID: Q15005
  ENSP ID: ENSP00000263672
MAAAAVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 79031 - protein, 157 aa, Homo sapiens
  Payload ID: 15744
  Gene Symbol: SPCS2
  Gene Name: signal peptidase complex subunit 2
  ENSP ID: ENSP00000433439
MAAAAVQGGRSGGSGGCSGAGGASNCGTGSGRSGLLDKWKIDDKPVKIDKWDGSAVKNSLDDSAKKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 79032 - protein, 87 aa, Homo sapiens
  Payload ID: 15744
  Gene Symbol: SPCS2
  Gene Name: signal peptidase complex subunit 2
  ENSP ID: ENSP00000434248
MILPKRKDPTGMDPDDIWQLSSSLKRFDDKYTLKLTFISGRTKQQREAEFTKSIAKFFDHSGTLVMDAYEPEISRLHDSLAIERKIK

SEQ ID NO: 79033 - protein, 166 aa, Homo sapiens
  Payload ID: 15744
  Gene Symbol: SPCS2
  Gene Name: signal peptidase complex subunit 2
  ENSP ID: ENSP00000434706
ITTLRTLGACPCPHHTSNLDPVLFRTSSFLASVLVLVATPFSWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSS

SEQ ID NO: 79034 - protein, 257 aa, Homo sapiens
  Payload ID: 15744
  Gene Symbol: SPCS2
  Gene Name: signal peptidase complex subunit 2
  ENSP ID: ENSP00000436759
MAAAAVQGGRSGGSGGCSGAGGASNCGTGSGRSGLLDKRQALTILPRLDSSSWAQAVLPPQPPKYLGWQWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 79035 - protein, 227 aa, Homo sapiens
  Payload ID: 15744
  Gene Symbol: SPCS2
  Gene Name: signal peptidase complex subunit 2
  ENSP ID: ENSP00000478550
MAAAAVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISSYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 79036 - protein, 180 aa, Homo sapiens
  Payload ID: 15745
  Gene Symbol: SPCS3
  Gene Name: signal peptidase complex subunit 3
  Uniprot ID: P61009
  ENSP ID: ENSP00000427463
MNTVLSRANSLFAFSLSVMAALTFGCFITTAFKDRSVPVRLHVSRIMLKNVEDFTGPRERSDLGFITFDITADLENIFDWNVKQLFLYLSAEYSTKNNALNQVVLWDKIVLRGDNPKLLLKDMKTKYFFFDDGNGLKGNRNVTLTLSWNVVPNAGILPLVTGSGHVSVPFPDTYEITKSY

SEQ ID NO: 79037 - protein, 520 aa, Homo sapiens
  Payload ID: 15746
  Gene Symbol: SPPL2A
  Gene Name: signal peptide peptidase like 2A
  Uniprot ID: Q8TCT8
  ENSP ID: ENSP00000261854
MGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 79038 - protein, 356 aa, Homo sapiens
  Payload ID: 15746
  Gene Symbol: SPPL2A
  Gene Name: signal peptide peptidase like 2A
  ENSP ID: ENSP00000453927
  MOD_RES (1)..(1): Any amino acid
XALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKNDGNLVEATGQPSAPHEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 79039 - protein, 149 aa, Homo sapiens
  Payload ID: 15746
  Gene Symbol: SPPL2A
  Gene Name: signal peptide peptidase like 2A
  ENSP ID: ENSP00000453932
MLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSG

SEQ ID NO: 79040 - protein, 165 aa, Homo sapiens
  Payload ID: 15747
  Gene Symbol: SPPL2B
  Gene Name: signal peptide peptidase like 2B
  ENSP ID: ENSP00000477658
  MOD_RES (1)..(1): Any amino acid
XGTVAIGGYWAGSRDVKKYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKAC

SEQ ID NO: 79041 - protein, 592 aa, Homo sapiens
  Payload ID: 15747
  Gene Symbol: SPPL2B
  Gene Name: signal peptide peptidase like 2B
  Uniprot ID: Q8TCT7
  ENSP ID: ENSP00000478298
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAKVLPPSPWAPAPADGPQPPKDSATPLSPQPPSEEPATSPWPAEQSPKSRTSEEMGAGAPMREPGSPAESEGRDQAQPSPVTQPGASA

SEQ ID NO: 79042 - protein, 511 aa, Homo sapiens
  Payload ID: 15747
  Gene Symbol: SPPL2B
  Gene Name: signal peptide peptidase like 2B
  Uniprot ID: Q8TCT7
  ENSP ID: ENSP00000478510
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQWAWVLQDALGIAFCLYMLKTIRLPTFKACTLLLLVLFLYDIFFVFITPFLTKSGSSIMVEVATGPSDSATREKLPMVLKVPRLNSSPLALCDRPFSLLGFGDILVPGLLVAYCHRFDIQVQSSRVYFVACTIAYGVGLLVTFVALALMQRGQPALLYLVPCTLVTSCAVALWRRELGVFWTGSGFAVNTSLL

SEQ ID NO: 79043 - protein, 81 aa, Homo sapiens
  Payload ID: 15747
  Gene Symbol: SPPL2B
  Gene Name: signal peptide peptidase like 2B
  ENSP ID: ENSP00000480311
MAAAVAAALARLLAAFLLLAAQVACEYGMVHVVSQAGGPEGKDYCILYNPQWAHLPHDLSKAMPGRGGAAVGTHLVLLSDL

SEQ ID NO: 79044 - protein, 319 aa, Homo sapiens
  Payload ID: 15747
  Gene Symbol: SPPL2B
  Gene Name: signal peptide peptidase like 2B
  Uniprot ID: Q8TCT7
  ENSP ID: ENSP00000480813
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQ

SEQ ID NO: 79045 - protein, 291 aa, Homo sapiens
  Payload ID: 15747
  Gene Symbol: SPPL2B
  Gene Name: signal peptide peptidase like 2B
  ENSP ID: ENSP00000482362
MVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIFCLASATGLYSCLAPCVRRLPFGKCRIPNNSLPYFHKRPQARMLLLALFCVAVSVVWGVFRNEDQ

SEQ ID NO: 79046 - protein, 139 aa, Homo sapiens
  Payload ID: 15747
  Gene Symbol: SPPL2B
  Gene Name: signal peptide peptidase like 2B
  ENSP ID: ENSP00000482470
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLLQRHAGHLHGSVSAAR

SEQ ID NO: 79047 - protein, 684 aa, Homo sapiens
  Payload ID: 15748
  Gene Symbol: SPPL2C
  Gene Name: signal peptide peptidase like 2C
  Uniprot ID: Q8IUH8
  ENSP ID: ENSP00000332488
MACLGFLLPVGFLLLISTVAGGKYGVAHVVSENWSKDYCILFSSDYITLPRDLHHAPLLPLYDGTKAPWCPGEDSPHQAQLRSPSQRPLRQTTAMVMRGNCSFHTKGWLAQGQGAHGLLIVSRVSDQQCSDTTLAPQDPRQPLADLTIPVAMLHYADMLDILSHTRGEAVVRVAMYAPPEPIIDYNMLVIFILAVGTVAAGGYWAGLTEANRLQRRRARRGGGSGGHHQLQEAAAAEGAQKEDNEDIPVDFTPAMTGVVVTLSCSLMLLLYFFYDHFVYVTIGIFGLGAGIGLYSCLSPLVCRLSLRQYQRPPHSLWASLPLPLLLLASLCATVIIFWVAYRNEDRWAWLLQDTLGISYCLFVLHRVRLPTLKNCSSFLLALLAFDVFFVFVTPFFTKTGESIMAQVALGPAESSSHERLPMVLKVPRLRVSALTLCSQPFSILGFGDIVVPGFLVAYCCRFDVQVCSRQIYFVACTVAYAVGLLVTFMAMVLMQMGQPALLYLVSSTLLTSLAVAACRQELSLFWTGQGRAKMCGLGCAPSAGSRQKQEGAADAHTASTLERGTSRGAGDLDSNPGEDTTEIVTISENEATNPEDRSDSSEGWSDAHLDPNELPFIPPGASEELMPLMPMAMLIPLMPLMPPPSELGHVHAQAQAHETGLPWAGLHKRKGLKVRKSMSTQAPL

SEQ ID NO: 79048 - protein, 684 aa, Homo sapiens
  Payload ID: 15748
  Gene Symbol: SPPL2C
  Gene Name: signal peptide peptidase like 2C
  ENSP ID: ENSP00000481353
MACLGFLLPVGFLLLISTVAGGKYGVAHVVSENWSKDYCILFSSDYITLPRDLHHAPLLPLYDGTKAPWCPGEDSPHQAQLRSPSQRPLRQTTAMVMRGNCSFHTKGWLAQGQGAHGLLIVSRVSDQQCSDTTLAPQDPRQPLADLTIPVAMLHYADMLDILSHTRGEAVVRVAMYAPPEPIIDYNMLVIFILAVGTVAAGGYWAGLTEANRLQRRRARRGGGPGGHHQLQEAAAAEGAQKEDNEDIPVDFTPAMTGVVVTLSCSLMLLLYFFYDHFVYVTIGIFGLGAGIGLYSCLSPLVCRLSLRQYQRPPHSLWASLPLPLLLLASLCTTVIIFWVAYRNEDRWAWLLQDTLGISYCLFVLHRVRLPTLKNCSSFLLALLAFDVFFVFVTPFFTKTGESIMAQVALGPAESSSHERLPMVLKVPRLRVSALTLCSQPFSILGFGDIVVPGFLVAYCCPFDVQVCSRQVYFVACTVAYAVGLLVTFMAMVLMQMGQPALLYLVSSTLLTSLAVAACRQELSLFWTGQGRAKMCGLGCAPSAGSRQKQEGAADAHTASTLERGTSRGAGDLDSNPGEDTTEIVTISENEATNPEDRSDSPEGWSDAHLDPNELPFIPPRASEELMPLMPMAMLIPLMPLMPRPSELGHVHAQAQAHETGLPWAGLHKRKGLKVRKSMSTQAPL

SEQ ID NO: 79049 - protein, 684 aa, Homo sapiens
  Payload ID: 15748
  Gene Symbol: SPPL2C
  Gene Name: signal peptide peptidase like 2C
  ENSP ID: ENSP00000483514
MACLGFLLPVGFLLLISTVAGGKYGVAHVVSENWSKDYCILFSSDYITLPRDLHHAPLLPLYDGTKAPWCPGEDSPHQAQLRSPSQRPLRQTTAMVMRGNCSFHTKGWLAQGQGAHGLLIVSRVSDQQCSDTTLAPQDPRQPLADLTIPVAMLHYADMLDILSHTRGEAVVRVAMYAPPEPIIDYNMLVIFILAVGTVAAGGYWAGLTEANRLQRRRARRGGGSGGHHQLQEAAAAEGAQKEDNEDIPVDFTPAMTGVVVTLSCSLMLLLYFFYDHFVYVTIGIFGLGAGIGLYSCLSPLVCHLSLRQYQRPPHSLWASLPLPLLLLASLCATVIIFWVAYRNEDRWAWLLQDTLGISYCLFVLHRVRLPTLKNCSSFLLALLAFDVFFVFVTPFFTKTGESIMAQVALGPAESSSHERLPMVLKVPRLRVSALTLCSQPFSILGFGDIVVPGFLVAYCCRFDVQVCSRQIYFVACTVAYAVGLLVTFMAMVLMQMGQPALLYLVSSTLLTSLAVAACRQELSLFWTGQGRAKMCGLGCAPSAGSRQKQEGAADAHTASTLERGTSRGAGDLDSNPGEDTTEIVTISENEATNPEDRSDSSEGWSDAHLDPNELPFIPPGASEELMPLMPMAMLIPLMPLMPPPSELGHVHAQAQAHETGLPWAGLHKRKGLKVRKSMSTQAPL

SEQ ID NO: 79050 - protein, 384 aa, Homo sapiens
  Payload ID: 15749
  Gene Symbol: SPPL3
  Gene Name: signal peptide peptidase like 3
  Uniprot ID: Q8TCT6
  ENSP ID: ENSP00000288680
MAEQTYSWAYSLVDSSQVSTFLISILLIVYGSFRSLNMDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 79051 - protein, 164 aa, Homo sapiens
  Payload ID: 15749
  Gene Symbol: SPPL3
  Gene Name: signal peptide peptidase like 3
  ENSP ID: ENSP00000437603
MDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDV

SEQ ID NO: 79052 - protein, 102 aa, Homo sapiens
  Payload ID: 15749
  Gene Symbol: SPPL3
  Gene Name: signal peptide peptidase like 3
  ENSP ID: ENSP00000439390
MFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKV

SEQ ID NO: 79053 - protein, 183 aa, Homo sapiens
  Payload ID: 15749
  Gene Symbol: SPPL3
  Gene Name: signal peptide peptidase like 3
  ENSP ID: ENSP00000442484
MDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVA

SEQ ID NO: 79054 - protein, 66 aa, Homo sapiens
  Payload ID: 15749
  Gene Symbol: SPPL3
  Gene Name: signal peptide peptidase like 3
  ENSP ID: ENSP00000444821
MDFENQDKEKDSNSSSGSFNGNSTNNSIQTIDSTQALFLPIGASVSLLVMFFFFDSVQVVFTICTA

SEQ ID NO: 79055 - protein, 118 aa, Homo sapiens
  Payload ID: 15749
  Gene Symbol: SPPL3
  Gene Name: signal peptide peptidase like 3
  ENSP ID: ENSP00000446088
MDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVL

SEQ ID NO: 79056 - protein, 347 aa, Homo sapiens
  Payload ID: 15750
  Gene Symbol: SCUBE1
  Gene Name: signal peptide, CUB domain, EGF-like 1
  ENSP ID: ENSP00000290460
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKGQHVELCGCPCLYWPGQEPPCACIAGPRAGLNGGHV

SEQ ID NO: 79057 - protein, 988 aa, Homo sapiens
  Payload ID: 15750
  Gene Symbol: SCUBE1
  Gene Name: signal peptide, CUB domain, EGF-like 1
  Uniprot ID: Q8IWY4
  ENSP ID: ENSP00000354080
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIETCAVNNGGCDRTCKDTATGVRCSCPVGFTLQPDGKTCKDINECLVNNGGCDHFCRNTVGSFECGCRKGYKLLTDERTCQDIDECSFERTCDHICINSPGSFQCLCHRGYILYGTTHCGDVDECSMSNGSCDQGCVNTKGSYECVCPPGRRLHWNGKDCVETGKCLSRAKTSPRAQLSCSKAGGVESCFLSCPAHTLFVPDSENSYVLSCGVPGPQGKALQKRNGTSSGLGPSCSDAPTTPIKQKARFKIRDAKCHLRPHSQARAKETARQPLLDHCHVTFVTLKCDSSKKRRRGRKSPSKEVSHITAEFEIETKMEEASDTCEADCLRKRAEQSLQAAIKTLRKSIGRQQFYVQVSGTEYEVAQRPAKALEGQGACGAGQVLQDSKCVACGPGTHFGGELGQCVSCMPGTYQDMEGQLSCTPCPSSDGLGLPGARNVSECGGQCSPGFFSADGFKPCQACPVGTYQPEPGRTGCFPCGGGLLTKHEGTTSFQDCEAKVHCSPGHHYNTTTHRCIRCPVGTYQPEFGQNHCITCPGNTSTDFDGSTNVTHCKNQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDEDYQQLIEDIVRDGRLYASENHQEILKDKKLIKALFDVLAHPQNYFKYTAQESKEMFPRSFIKLLRSKVSRFLRPYK

SEQ ID NO: 79058 - protein, 175 aa, Homo sapiens
  Payload ID: 15750
  Gene Symbol: SCUBE1
  Gene Name: signal peptide, CUB domain, EGF-like 1
  ENSP ID: ENSP00000395327
  MOD_RES (1)..(1): Any amino acid
XRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKDINECLVNNGGCDHFCRNTVGSFECGCRKGYKLLTDERTC

SEQ ID NO: 79059 - protein, 363 aa, Homo sapiens [sequence omitted]

SEQ ID NO: 79060 - protein, 999 aa, Homo sapiens
  Payload ID: 15751
  Gene Symbol: SCUBE2
  Gene Name: signal peptide, CUB domain, EGF-like 2
  Uniprot ID: Q9NQ36
  ENSP ID: ENSP00000310658
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 79061 - protein, 807 aa, Homo sapiens
  Payload ID: 15751
  Gene Symbol: SCUBE2
  Gene Name: signal peptide, CUB domain, EGF-like 2
  Uniprot ID: Q9NQ36
  ENSP ID: ENSP00000415187
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKTSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 79062 - protein, 971 aa, Homo sapiens
  Payload ID: 15751
  Gene Symbol: SCUBE2
  Gene Name: signal peptide, CUB domain, EGF-like 2
  ENSP ID: ENSP00000429969
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSGLQGAYSVTCGSSSPLRNKQQKSNDSAFGDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 79063 - protein, 119 aa, Homo sapiens
  Payload ID: 15751
  Gene Symbol: SCUBE2
  Gene Name: signal peptide, CUB domain, EGF-like 2
  ENSP ID: ENSP00000432828
  MOD_RES (1)..(1): Any amino acid
XYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDGKHSLQHMERASLL

SEQ ID NO: 79064 - protein, 171 aa, Homo sapiens
  Payload ID: 15751
  Gene Symbol: SCUBE2
  Gene Name: signal peptide, CUB domain, EGF-like 2
  ENSP ID: ENSP00000434000
  MOD_RES (1)..(1): Any amino acid
XCSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGEVKG

SEQ ID NO: 79065 - protein, 192 aa, Homo sapiens
  Payload ID: 15751
  Gene Symbol: SCUBE2
  Gene Name: signal peptide, CUB domain, EGF-like 2
  ENSP ID: ENSP00000435415
  MOD_RES (1)..(1): Any amino acid
XKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVVKGLLPTSVSPRVSLHCGKSGGGDG

SEQ ID NO: 79066 - protein, 112 aa, Homo sapiens
  Payload ID: 15751
  Gene Symbol: SCUBE2
  Gene Name: signal peptide, CUB domain, EGF-like 2
  ENSP ID: ENSP00000435902
  MOD_RES (1)..(1): Any amino acid
XGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDDA

SEQ ID NO: 79067 - protein, 993 aa, Homo sapiens
  Payload ID: 15752
  Gene Symbol: SCUBE3
  Gene Name: signal peptide, CUB domain, EGF-like 3
  Uniprot ID: Q8IX30
  ENSP ID: ENSP00000274938
MGSGRVPGLCLLVLLVHARAAQYSKAAQDVDECVEGTDNCHIDAICQNTPRSYKCICKSGYTGDGKHCKDVDECEREDNAGCVHDCVNIPGNYRCTCYDGFHLAHDGHNCLDVDECAEGNGGCQQSCVNMMGSYECHCREGFFLSDNQHTCIQRPEEGMNCMNKNHGCAHICRETPKGGIACECRPGFELTKNQRDCKLTCNYGNGGCQHTCDDTEQGPRCGCHIKFVLHTDGKTCIETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRASFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVSCPQGTYYHGQTEQCVPCPAGTFQEREGQLSCDLCPGSDAHGPLGATNVTTCAGQCPPGQHSVDGFKPCQPCPRGTYQPEAGRTLCFPCGGGLTTKHEGAISFQDCDTKVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNSSPSSITTYETCQTYERPIAFTARSRKLWINFKTSEANSARGFQIPYVTYDEDYEQLVEDIVRDGRLYASENHQEILKDKKLIKAFFEVLAHPQNYFKYTEKHKEMLPKSFIKLLRSKVSSFLRPYK

SEQ ID NO: 79068 - protein, 136 aa, Homo sapiens
  Payload ID: 15753
  Gene Symbol: SRP14
  Gene Name: signal recognition particle 14kDa (homologous Alu RNA binding protein)
  Uniprot ID: P37108
  ENSP ID: ENSP00000267884
MVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAAAAAPAAAATAPTTAATTAATAAQ

SEQ ID NO: 79069 - protein, 56 aa, Homo sapiens
  Payload ID: 15753
  Gene Symbol: SRP14
  Gene Name: signal recognition particle 14kDa (homologous Alu RNA binding protein)
  ENSP ID: ENSP00000452756
MAYSNLLRANMDGLKKRDKKNKTKKTKAAAAAAAAAPAAAATAPTTAATTAATAAQ

SEQ ID NO: 79070 - protein, 115 aa, Homo sapiens
  Payload ID: 15753
  Gene Symbol: SRP14
  Gene Name: signal recognition particle 14kDa (homologous Alu RNA binding protein)
  ENSP ID: ENSP00000453120
MVLLESEQFLTELTRLFQKCRTSGSVYITLKKYDGRTKPIPKKGTVEGFEPADNKCLLRATDGKKKISTVVSSKEVNKFQMVSFGCSLCFPSQGKSQYDSEHWVRLILGFTALRR

SEQ ID NO: 79071 - protein, 56 aa, Homo sapiens; identical to SEQ ID NO: 79069
  Payload ID: 15753
  Gene Symbol: SRP14
  Gene Name: signal recognition particle 14kDa (homologous Alu RNA binding protein)
  ENSP ID: ENSP00000453361

SEQ ID NO: 79072 - protein, 110 aa, Homo sapiens
  Payload ID: 15754
  Gene Symbol: SRP19
  Gene Name: signal recognition particle 19kDa
  Uniprot ID: P09132
  ENSP ID: ENSP00000282999
MACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSHYTLSLTSGS

SEQ ID NO: 79073 - protein, 144 aa, Homo sapiens
  Payload ID: 15754
  Gene Symbol: SRP19
  Gene Name: signal recognition particle 19kDa
  Uniprot ID: P09132
  ENSP ID: ENSP00000424870
MACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSRKSVMLYAAEMIPKLKTRTQKTGGADQSLQQGEGSKKGKGKKKK

SEQ ID NO: 79074 - protein, 78 aa, Homo sapiens
  Payload ID: 15754
  Gene Symbol: SRP19
  Gene Name: signal recognition particle 19kDa
  Uniprot ID: P09132
  ENSP ID: ENSP00000425562
MACAAARSPADQDRLLKILQLQRFKMYVQQLDLTYFLRKIKCTLENGIVMSNTEAESGSSSNRKMGASALYSSHHVSQ

SEQ ID NO: 79075 - protein, 104 aa, Homo sapiens
  Payload ID: 15754
  Gene Symbol: SRP19
  Gene Name: signal recognition particle 19kDa
  ENSP ID: ENSP00000480521
MACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSRKLV

SEQ ID NO: 79076 - protein, 120 aa, Homo sapiens
  Payload ID: 15754
  Gene Symbol: SRP19
  Gene Name: signal recognition particle 19kDa
  ENSP ID: ENSP00000482018
MACAAARSPADQDRFICIYPAYLNNKKTIAEGRRIPISKKNKMYSREWNRDVQYRGRVRVQLKQEDGSLCLVQFPSRKSVMLYAAEMIPKLKTRTQKTGGADQSLQQGEGSKKGKGKKKK

SEQ ID NO: 79077 - protein, 504 aa, Homo sapiens
  Payload ID: 15755
  Gene Symbol: SRP54
  Gene Name: signal recognition particle 54kDa
  Uniprot ID: P61011
  ENSP ID: ENSP00000216774
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 79078 - protein, 455 aa, Homo sapiens
  Payload ID: 15755
  Gene Symbol: SRP54
  Gene Name: signal recognition particle 54kDa
  Uniprot ID: P61011
  ENSP ID: ENSP00000440629
MPPLSMKRSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 79079 - protein, 43 aa, Homo sapiens
  Payload ID: 15755
  Gene Symbol: SRP54
  Gene Name: signal recognition particle 54kDa
  ENSP ID: ENSP00000451037
MVLADLGRKITSALRSLSNATIINEEVLNAMLKEVCTALLEAD

SEQ ID NO: 79080 - protein, 55 aa, Homo sapiens
  Payload ID: 15755
  Gene Symbol: SRP54
  Gene Name: signal recognition particle 54kDa
  ENSP ID: ENSP00000451313
MVLADLGRKITSALRSLSNATIINEEVLNAMLKEVCTALLEDLFNMCRHIQSRGF

SEQ ID NO: 79081 - protein, 74 aa, Homo sapiens
  Payload ID: 15755
  Gene Symbol: SRP54
  Gene Name: signal recognition particle 54kDa
  ENSP ID: ENSP00000451647
MVLADLGRKITSALRSLSNATIINEEVLNAMLKEVCTALLEADVNIKLVKQLRENVKSAIDLEEMASGLNKRKM

SEQ ID NO: 79082 - protein, 440 aa, Homo sapiens
  Payload ID: 15755
  Gene Symbol: SRP54
  Gene Name: signal recognition particle 54kDa
  ENSP ID: ENSP00000451775
MASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 79083 - protein, 504 aa, Homo sapiens; identical to SEQ ID NO: 79077
  Payload ID: 15755
  Gene Symbol: SRP54
  Gene Name: signal recognition particle 54kDa
  Uniprot ID: P61011
  ENSP ID: ENSP00000451818

SEQ ID NO: 79084 - protein, 53 aa, Homo sapiens
  Payload ID: 15755
  Gene Symbol: SRP54
  Gene Name: signal recognition particle 54kDa
  ENSP ID: ENSP00000486764
MVLADLGRKITSALRSLSNATIINEEVLNAMLKEVCTALLEDLFNMCRHIQSR

SEQ ID NO: 79085 - protein, 627 aa, Homo sapiens
  Payload ID: 15756
  Gene Symbol: SRP68
  Gene Name: signal recognition particle 68kDa
  Uniprot ID: Q9UHB9
  ENSP ID: ENSP00000312066
MAAEKQVPGGGGGGGSGGGGGSGGGGSGGGRGAGGEENKENERPSAGSKANKEFGDSLSLEILQIIKESQQQHGLRHGDFQRYRGYCSRRQRRLRKTLNFKMGNRHKFTGKKVTEELLTDNRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGDQSAINELMQMRLRSGGTEGLLAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 79086 - protein, 589 aa, Homo sapiens
  Payload ID: 15756
  Gene Symbol: SRP68
  Gene Name: signal recognition particle 68kDa
  Uniprot ID: Q9UHB9
  ENSP ID: ENSP00000446136
MAAEKQVPGGGGGGGSGGGGGSGGGGSGGGRGAGGEENKENERPSAGSKANKEFGDSLSLEILQIIKESQQQHGLRHGDFQRYRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGDQSAINELMQMRLRSGGTEGLLAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 79087 - protein, 54 aa, Homo sapiens
  Payload ID: 15756
  Gene Symbol: SRP68
  Gene Name: signal recognition particle 68kDa
  ENSP ID: ENSP00000466791
MAAEKQVPGGGGGGGSGGGGGSGGGGSGGGRGAGGEENKENERPSAGSKGLLFP

SEQ ID NO: 79088 - protein, 63 aa, Homo sapiens
  Payload ID: 15756
  Gene Symbol: SRP68
  Gene Name: signal recognition particle 68kDa
  ENSP ID: ENSP00000467765
MAAEKQVPGGGGGGGSGGGGGSGGGGSGGGRGAGGEENKENERPSAGSKANKEFGDSLSLENY

SEQ ID NO: 79089 - protein, 288 aa, Homo sapiens
  Payload ID: 15756
  Gene Symbol: SRP68
  Gene Name: signal recognition particle 68kDa
  Uniprot ID: Q9UHB9
  ENSP ID: ENSP00000473613
MLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 79090 - protein, 54 aa, Homo sapiens; identical to SEQ ID NO: 79087
  Payload ID: 15756
  Gene Symbol: SRP68
  Gene Name: signal recognition particle 68kDa
  ENSP ID: ENSP00000486633

SEQ ID NO: 79091 - protein, 671 aa, Homo sapiens
  Payload ID: 15757
  Gene Symbol: SRP72
  Gene Name: signal recognition particle 72kDa
  Uniprot ID: O76094
  ENSP ID: ENSP00000342181
MASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 79092 - protein, 610 aa, Homo sapiens
  Payload ID: 15757
  Gene Symbol: SRP72
  Gene Name: signal recognition particle 72kDa
  Uniprot ID: O76094
  ENSP ID: ENSP00000424576
MASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 79093 - protein, 357 aa, Homo sapiens
  Payload ID: 15757
  Gene Symbol: SRP72
  Gene Name: signal recognition particle 72kDa
  ENSP ID: ENSP00000425190
  MOD_RES (1)..(1): Any amino acid
XERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKE

SEQ ID NO: 79094 - protein, 220 aa, Homo sapiens
  Payload ID: 15757
  Gene Symbol: SRP72
  Gene Name: signal recognition particle 72kDa
  ENSP ID: ENSP00000473576
MASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEGWKFVKLICKYNVHITL

SEQ ID NO: 79095 - protein, 86 aa, Homo sapiens
  Payload ID: 15758
  Gene Symbol: SRP9
  Gene Name: signal recognition particle 9kDa
  Uniprot ID: P49458
  ENSP ID: ENSP00000305230
MPQYQTWEEFSRAAEKLYLADPMKARVVLKYRHSDGNLCVKVTDDLVCLVYKTDQAQDVKKIEKFHSQLMRLMVAKEARNVTMETE

SEQ ID NO: 79096 - protein, 66 aa, Homo sapiens
  Payload ID: 15758
  Gene Symbol: SRP9
  Gene Name: signal recognition particle 9kDa
  ENSP ID: ENSP00000355803
MPQYQTWEEFSRAAEKLYLADPMKARVVLKYRHSDGNLCVKVTDDLVQWHLNYCTLRHGIAGGLET

SEQ ID NO: 79097 - protein, 82 aa, Homo sapiens
  Payload ID: 15758
  Gene Symbol: SRP9
  Gene Name: signal recognition particle 9kDa
  Uniprot ID: P49458
  ENSP ID: ENSP00000355804
MPQYQTWEEFSRAAEKLYLADPMKARVVLKYRHSDGNLCVKVTDDLVRQCLALLLRLQCSGMIIAHCILDLLGSSGPLASAS

SEQ ID NO: 79098 - protein, 82 aa, Homo sapiens; identical to SEQ ID NO: 79097
  Payload ID: 15758
  Gene Symbol: SRP9
  Gene Name: signal recognition particle 9kDa
  Uniprot ID: P49458
  ENSP ID: ENSP00000485002

SEQ ID NO: 79099 - protein, 66 aa, Homo sapiens; identical to SEQ ID NO: 79096
  Payload ID: 15758
  Gene Symbol: SRP9
  Gene Name: signal recognition particle 9kDa
  ENSP ID: ENSP00000485985

SEQ ID NO: 79100 - protein, 638 aa, Homo sapiens
  Payload ID: 15759
  Gene Symbol: SRPR
  Gene Name: signal recognition particle receptor (docking protein)
  Uniprot ID: P08240
  ENSP ID: ENSP00000328023
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 79101 - protein, 610 aa, Homo sapiens
  Payload ID: 15759
  Gene Symbol: SRPR
  Gene Name: signal recognition particle receptor (docking protein)
  Uniprot ID: P08240
  ENSP ID: ENSP00000435508
MLDFFTIFSKGGLVLWCFQGVSDSCTGPVNALIRSVLLQVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 79102 - protein, 92 aa, Homo sapiens
  Payload ID: 15760
  Gene Symbol: SRPRB
  Gene Name: signal recognition particle receptor, B subunit
  ENSP ID: ENSP00000417096
MASADSRRVADGGGAGGTFQPYLDTLRQELQQTDPTLLSVVVAVLAVLLTLVFWKLIRSRRSSQRAVLLVGLCDSGKTLLFVRLLTGLYRDT

SEQ ID NO: 79103 - protein, 160 aa, Homo sapiens
  Payload ID: 15760
  Gene Symbol: SRPRB
  Gene Name: signal recognition particle receptor, B subunit
  ENSP ID: ENSP00000417316
  MOD_RES (1)..(1): Any amino acid
XLTLIDLPGHESLRLQFLERFKSSARAIVFVVDSAAFQREVKDVAEFLYQVLIDSMGLKNTPSFLIACNKQDIAMAKSAKLIQQQLEKELNTLRVTRSAAPSTLDSSSTAPAQLGKKGKEFEFSQLPLKVEFLECSAKGGRGDVGSADIQDLEKWLAKIA

SEQ ID NO: 79104 - protein, 271 aa, Homo sapiens
  Payload ID: 15760
  Gene Symbol: SRPRB
  Gene Name: signal recognition particle receptor, B subunit
  Uniprot ID: Q9Y5M8
  ENSP ID: ENSP00000418401
MASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSARAIVFVVDSAAFQREVKDVAEFLYQVLIDSMGLKNTPSFLIACNKQDIAMAKSAKLIQQQLEKELNTLRVTRSAAPSTLDSSSTAPAQLGKKGKEFEFSQLPLKVEFLECSAKGGRGDVGSADIQDLEKWLAKIA

SEQ ID NO: 79105 - protein, 286 aa, Homo sapiens
  Payload ID: 15761
  Gene Symbol: SSR1
  Gene Name: signal sequence receptor, alpha
  Uniprot ID: P43307
  ENSP ID: ENSP00000244763
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 79106 - protein, 291 aa, Homo sapiens
  Payload ID: 15761
  Gene Symbol: SSR1
  Gene Name: signal sequence receptor, alpha
  ENSP ID: ENSP00000380647
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQIMQSRRDKASPRRLPRKRAQKRSVGSDE

SEQ ID NO: 79107 - protein, 265 aa, Homo sapiens
  Payload ID: 15761
  Gene Symbol: SSR1
  Gene Name: signal sequence receptor, alpha
  ENSP ID: ENSP00000417290
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKSGSFIQDGVQWHNLAYCNLRLRGSSHPPTSAS

SEQ ID NO: 79108 - protein, 266 aa, Homo sapiens
  Payload ID: 15761
  Gene Symbol: SSR1
  Gene Name: signal sequence receptor, alpha
  ENSP ID: ENSP00000417911
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQISK

SEQ ID NO: 79109 - protein, 298 aa, Homo sapiens
  Payload ID: 15761
  Gene Symbol: SSR1
  Gene Name: signal sequence receptor, alpha
  ENSP ID: ENSP00000418617
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQIMQSRRDKASPRRLPRKRAQKRSVGSDERRRRETH

SEQ ID NO: 79110 - protein, 103 aa, Homo sapiens
  Payload ID: 15761
  Gene Symbol: SSR1
  Gene Name: signal sequence receptor, alpha
  ENSP ID: ENSP00000419953
MGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQISK

SEQ ID NO: 79111 - protein, 218 aa, Homo sapiens
  Payload ID: 15761
  Gene Symbol: SSR1
  Gene Name: signal sequence receptor, alpha
  ENSP ID: ENSP00000420730
MRLLPRLLLLLLLVFPATVLFRGGPRGLLAVAQDLTEDEETVEDSIIEDEDDEAEVEEDEPTDLVEDKEEEDVSGEPEASPSADTTILFVKGEEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 79112 - protein, 183 aa, Homo sapiens
  Payload ID: 15762
  Gene Symbol: SSR2
  Gene Name: signal sequence receptor, beta (translocon-associated protein beta)
  Uniprot ID: P43308
  ENSP ID: ENSP00000295702
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 79113 - protein, 90 aa, Homo sapiens
  Payload ID: 15762
  Gene Symbol: SSR2
  Gene Name: signal sequence receptor, beta (translocon-associated protein beta)
  ENSP ID: ENSP00000431366
MRLLSFVVLALFAVTQAEEGARLLASKSLLNRYAVEGRDLTLQYNIYNVGSSAALDVELSDDSFPPEDFGIVSGMLNVKWDRIAPYPLGT

SEQ ID NO: 79114 - protein, 62 aa, Homo sapiens
  Payload ID: 15762
  Gene Symbol: SSR2
  Gene Name: signal sequence receptor, beta (translocon-associated protein beta)
  ENSP ID: ENSP00000432831
MRLLSFVVLALFAVTQAEEGARLLASKSLLNRYAVEGRDLTLQYNIYNVGSRHVHEEKLRQG

SEQ ID NO: 79115 - protein, 183 aa, Homo sapiens; identical to SEQ ID NO: 79112
  Payload ID: 15762
  Gene Symbol: SSR2
  Gene Name: signal sequence receptor, beta (translocon-associated protein beta)
  Uniprot ID: P43308
  ENSP ID: ENSP00000434306

SEQ ID NO: 79116 - protein, 114 aa, Homo sapiens
  Payload ID: 15762
  Gene Symbol: SSR2
  Gene Name: signal sequence receptor, beta (translocon-associated protein beta)
  ENSP ID: ENSP00000434532
MPTGEDGRRVWRTGLLWWLMDYSVEGAAVLMRLLSFVVLALFAVTQAEEGARLLASKSLLNRYAVEGRDLTLQYNIYNVGSSAALDVELSDDSFPPEDFGIVSGMLNVKWDRIA

SEQ ID NO: 79117 - protein, 93 aa, Homo sapiens
  Payload ID: 15762
  Gene Symbol: SSR2
  Gene Name: signal sequence receptor, beta (translocon-associated protein beta)
  ENSP ID: ENSP00000434870
MRLLSFVVLALFAVTQAEEGARLLASKSLLNRYAVEGRDLTLQYNIYNVGSSAALDVELSDDSFPPEDFGIVSGMLNVKWDRIAPWTGQPLGS

SEQ ID NO: 79118 - protein, 133 aa, Homo sapiens
  Payload ID: 15762
  Gene Symbol: SSR2
  Gene Name: signal sequence receptor, beta (translocon-associated protein beta)
  ENSP ID: ENSP00000435692
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVNQPQDSLVLPGS

SEQ ID NO: 79119 - protein, 86 aa, Homo sapiens
  Payload ID: 15762
  Gene Symbol: SSR2
  Gene Name: signal sequence receptor, beta (translocon-associated protein beta)
  ENSP ID: ENSP00000436201
MRLLSFVVLALFAVTQAEEGARLLASKSLLNRYAVEGRDLTLQYNIYNVGSRLALPVHLDREESWLSGSLTGDSPLIFWTGQPLGS

SEQ ID NO: 79120 - protein, 147 aa, Homo sapiens
  Payload ID: 15762
  Gene Symbol: SSR2
  Gene Name: signal sequence receptor, beta (translocon-associated protein beta)
  ENSP ID: ENSP00000436228
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHF

SEQ ID NO: 79121 - protein, 133 aa, Homo sapiens; identical to SEQ ID NO: 79118
  Payload ID: 15762
  Gene Symbol: SSR2
  Gene Name: signal sequence receptor, beta (translocon-associated protein beta)
  ENSP ID: ENSP00000437239

SEQ ID NO: 79122 - protein, 173 aa, Homo sapiens
  Payload ID: 15763
  Gene Symbol: SSR4
  Gene Name: signal sequence receptor, delta
  Uniprot ID: P51571
  ENSP ID: ENSP00000317331
MAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 79123 - protein, 148 aa, Homo sapiens
  Payload ID: 15763
  Gene Symbol: SSR4
  Gene Name: signal sequence receptor, delta
  ENSP ID: ENSP00000359102
MAAMASLGALALLLLSSLSRCSAEACLEPQITPSYYTTSDAVISTETVFIVEISLTCKNRVQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 79124 - protein, 173 aa, Homo sapiens; identical to SEQ ID NO: 79122
  Payload ID: 15763
  Gene Symbol: SSR4
  Gene Name: signal sequence receptor, delta
  Uniprot ID: P51571
  ENSP ID: ENSP00000359103

SEQ ID NO: 79125 - protein, 173 aa, Homo sapiens; identical to SEQ ID NO: 79122
  Payload ID: 15763
  Gene Symbol: SSR4
  Gene Name: signal sequence receptor, delta
  Uniprot ID: P51571
  ENSP ID: ENSP00000359104

SEQ ID NO: 79126 - protein, 185 aa, Homo sapiens
  Payload ID: 15764
  Gene Symbol: SSR3
  Gene Name: signal sequence receptor, gamma (translocon-associated protein gamma)
  Uniprot ID: Q9UNL2
  ENSP ID: ENSP00000265044
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 79127 - protein, 133 aa, Homo sapiens
  Payload ID: 15764
  Gene Symbol: SSR3
  Gene Name: signal sequence receptor, gamma (translocon-associated protein gamma)
  ENSP ID: ENSP00000417306
MDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 79128 - protein, 174 aa, Homo sapiens
  Payload ID: 15764
  Gene Symbol: SSR3
  Gene Name: signal sequence receptor, gamma (translocon-associated protein gamma)
  ENSP ID: ENSP00000417530
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVYPFQGTTYCP

SEQ ID NO: 79129 - protein, 133 aa, Homo sapiens; identical to SEQ ID NO: 79127
  Payload ID: 15764
  Gene Symbol: SSR3
  Gene Name: signal sequence receptor, gamma (translocon-associated protein gamma)
  ENSP ID: ENSP00000420087

SEQ ID NO: 79130 - protein, 198 aa, Homo sapiens
  Payload ID: 15764
  Gene Symbol: SSR3
  Gene Name: signal sequence receptor, gamma (translocon-associated protein gamma)
  Uniprot ID: Q9UNL2
  ENSP ID: ENSP00000420641
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERFDSCLKYGHHKRGILWKKNEVADYEATTFSIFYNNTLFLVVVIVASFFILKNFNPTVNYILSISASSGLIALLSTGSK

SEQ ID NO: 79131 - protein, 750 aa, Homo sapiens
  Payload ID: 15765
  Gene Symbol: STAT1
  Gene Name: signal transducer and activator of transcription 1, 91kDa
  Uniprot ID: P42224
  ENSP ID: ENSP00000354394
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 79132 - protein, 712 aa, Homo sapiens
  Payload ID: 15765
  Gene Symbol: STAT1
  Gene Name: signal transducer and activator of transcription 1, 91kDa
  Uniprot ID: P42224
  ENSP ID: ENSP00000376136
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEV

SEQ ID NO: 79133 - protein, 714 aa, Homo sapiens
  Payload ID: 15765
  Gene Symbol: STAT1
  Gene Name: signal transducer and activator of transcription 1, 91kDa
  ENSP ID: ENSP00000376137
MWMSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEV

SEQ ID NO: 79134 - protein, 750 aa, Homo sapiens; identical to SEQ ID NO: 79131
  Payload ID: 15765
  Gene Symbol: STAT1
  Gene Name: signal transducer and activator of transcription 1, 91kDa
  Uniprot ID: P42224
  ENSP ID: ENSP00000386244

SEQ ID NO: 79135 - protein, 40 aa, Homo sapiens
  Payload ID: 15765
  Gene Symbol: STAT1
  Gene Name: signal transducer and activator of transcription 1, 91kDa
  ENSP ID: ENSP00000388240
  MOD_RES (1)..(1): Any amino acid
XSHPSRLQTTDNLLPMSPEEFDEVSRIVGSVEFDSMMNTV

SEQ ID NO: 79136 - protein, 58 aa, Homo sapiens
  Payload ID: 15765
  Gene Symbol: STAT1
  Gene Name: signal transducer and activator of transcription 1, 91kDa
  ENSP ID: ENSP00000388772
  MOD_RES (1)..(1): Any amino acid
XPENPLKYLYPNIDKDHAFGKYYSRPKEAPEPMELDGPKGTGYIKTELISVSEVTVLG

SEQ ID NO: 79137 - protein, 193 aa, Homo sapiens
  Payload ID: 15765
  Gene Symbol: STAT1
  Gene Name: signal transducer and activator of transcription 1, 91kDa
  ENSP ID: ENSP00000394512
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNRGSSSQNNRVAECH

SEQ ID NO: 79138 - protein, 180 aa, Homo sapiens
  Payload ID: 15765
  Gene Symbol: STAT1
  Gene Name: signal transducer and activator of transcription 1, 91kDa
  ENSP ID: ENSP00000402548
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNR

SEQ ID NO: 79139 - protein, 150 aa, Homo sapiens
  Payload ID: 15765
  Gene Symbol: STAT1
  Gene Name: signal transducer and activator of transcription 1, 91kDa
  ENSP ID: ENSP00000411398
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVK

SEQ ID NO: 79140 - protein, 69 aa, Homo sapiens
  Payload ID: 15765
  Gene Symbol: STAT1
  Gene Name: signal transducer and activator of transcription 1, 91kDa
  ENSP ID: ENSP00000416019
MSQWYELQQLDSKFLEQVHQLYDDSFPMEIRQYLAQWLEKQDWEHAANDVSFATIRFHDLLSQLDDQYS

SEQ ID NO: 79141 - protein, 193 aa, Homo sapiens; identical to SEQ ID NO: 79137
  Payload ID: 15765
  Gene Symbol: STAT1
  Gene Name: signal transducer and activator of transcription 1, 91kDa
  ENSP ID: ENSP00000438703

SEQ ID NO: 79142 - protein, 851 aa, Homo sapiens
  Payload ID: 15766
  Gene Symbol: STAT2
  Gene Name: signal transducer and activator of transcription 2, 113kDa
  Uniprot ID: P52630
  ENSP ID: ENSP00000315768
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQPFSQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 79143 - protein, 460 aa, Homo sapiens
  Payload ID: 15766
  Gene Symbol: STAT2
  Gene Name: signal transducer and activator of transcription 2, 113kDa
  ENSP ID: ENSP00000387354
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKVSENGGQGERKQLWKKA

SEQ ID NO: 79144 - protein, 847 aa, Homo sapiens
  Payload ID: 15766
  Gene Symbol: STAT2
  Gene Name: signal transducer and activator of transcription 2, 113kDa
  Uniprot ID: P52630
  ENSP ID: ENSP00000450751
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 79145 - protein, 65 aa, Homo sapiens
  Payload ID: 15766
  Gene Symbol: STAT2
  Gene Name: signal transducer and activator of transcription 2, 113kDa
  ENSP ID: ENSP00000450985
MAQWEMLQNLDSPFQDQLHQLYSHSLLPVDIRQYLAVWIEDQNWKLHLGVMIPRLPCYSSTSWIS

SEQ ID NO: 79146 - protein, 770 aa, Homo sapiens
  Payload ID: 15767
  Gene Symbol: STAT3
  Gene Name: signal transducer and activator of transcription 3 (acute-phase response factor)
  Uniprot ID: P40763
  ENSP ID: ENSP00000264657
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 79147 - protein, 672 aa, Homo sapiens
  Payload ID: 15767
  Gene Symbol: STAT3
  Gene Name: signal transducer and activator of transcription 3 (acute-phase response factor)
  ENSP ID: ENSP00000373923
MEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 79148 - protein, 769 aa, Homo sapiens
  Payload ID: 15767
  Gene Symbol: STAT3
  Gene Name: signal transducer and activator of transcription 3 (acute-phase response factor)
  Uniprot ID: P40763
  ENSP ID: ENSP00000384943
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGAAPYLKTKFICVTPTTCSNTIDLPMSPRTLDSLMQFGNNGEGAEPSAGGQFESLTFDMELTSECATSPM

SEQ ID NO: 79149 - protein, 722 aa, Homo sapiens
  Payload ID: 15767
  Gene Symbol: STAT3
  Gene Name: signal transducer and activator of transcription 3 (acute-phase response factor)
  Uniprot ID: P40763
  ENSP ID: ENSP00000467000
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPFIDAVWK

SEQ ID NO: 79150 - protein, 84 aa, Homo sapiens
  Payload ID: 15767
  Gene Symbol: STAT3
  Gene Name: signal transducer and activator of transcription 3 (acute-phase response factor)
  ENSP ID: ENSP00000467173
MRMAQWNQLQQLDTRYLEQLHQLYSDSFPMELRQFLAPWIESQDWAYAASKESHATLVFHNLLGEIDQQYSRFLQESNVLYQHN

SEQ ID NO: 79151 - protein, 770 aa, Homo sapiens; identical to SEQ ID NO: 79146
  Payload ID: 15767
  Gene Symbol: STAT3
  Gene Name: signal transducer and activator of transcription 3 (acute-phase response factor)
  Uniprot ID: P40763
  ENSP ID: ENSP00000467985

SEQ ID NO: 79152 - protein, 748 aa, Homo sapiens
  Payload ID: 15768
  Gene Symbol: STAT4
  Gene Name: signal transducer and activator of transcription 4
  Uniprot ID: Q14765
  ENSP ID: ENSP00000351255
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILAAANMPVQGPLEKSLQSSSVSERQRNVEHKVAAIKNSVQMTEQDTKYLEDLQDEFDYRYKTIQTMDQSDKNSAMVNQEVLTLQEMLNSLDFKRKEALSKMTQIIHETDLLMNTMLIEELQDWKRRQQIACIGGPLHNGLDQLQNCFTLLAESLFQLRRQLEKLEEQSTKMTYEGDPIPMQRTHMLERVTFLIYNLFKNSFVVERQPCMPTHPQRPLVLKTLIQFTVKLRLLIKLPELNYQVKVKASIDKNVSTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTIRSDSTEPHSPSDLLPMSPSVYAVLRENLSPTTIETAMKSPYSAE

SEQ ID NO: 79153 - protein, 748 aa, Homo sapiens; identical to SEQ ID NO: 79152
  Payload ID: 15768
  Gene Symbol: STAT4
  Gene Name: signal transducer and activator of transcription 4
  Uniprot ID: Q14765
  ENSP ID: ENSP00000376134

SEQ ID NO: 79154 - protein, 117 aa, Homo sapiens
  Payload ID: 15768
  Gene Symbol: STAT4
  Gene Name: signal transducer and activator of transcription 4
  ENSP ID: ENSP00000386288
MSQWNQVQQLEIKFLEQVDQFYDDNFPMEIRHLLAQWIENQDWEAASNNETMATILLQNLLIQLDEQLGRVSKEKNLLLIHNLKRIRKVLQSPGLATAQLPLDRHGETCIQRSKSCP

SEQ ID NO: 79155 - protein, 97 aa, Homo sapiens
  Payload ID: 15768
  Gene Symbol: STAT4
  Gene Name: signal transducer and activator of transcription 4
  ENSP ID: ENSP00000403238
MEIRHLLAQWIENQDWEAASNNETMATILLQNLLIQLDEQLGRVSKEKNLLLIHNLKRIRKVLQGKFHGNPMHVAVVISNCLREERRILAAANMPVQ

SEQ ID NO: 79156 - protein, 79 aa, Homo sapiens
  Payload ID: 15768
  Gene Symbol: STAT4
  Gene Name: signal transducer and activator of transcription 4
  ENSP ID: ENSP00000412397
MSQWNQVQQLEIKFLEQVDQFYDDNFPMEIRHLLAQWIENQDWEAASNNETMATILLQNLLIQLDEQLGRVSKEKNLLL

SEQ ID NO: 79157 - protein, 25 aa, Homo sapiens
  Payload ID: 15768
  Gene Symbol: STAT4
  Gene Name: signal transducer and activator of transcription 4
  ENSP ID: ENSP00000414322
MSQWNQVQQLEIKFLEQVDQFYDDN

SEQ ID NO: 79158 - protein, 794 aa, Homo sapiens
  Payload ID: 15769
  Gene Symbol: STAT5A
  Gene Name: signal transducer and activator of transcription 5A
  Uniprot ID: P42229
  ENSP ID: ENSP00000341208
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 79159 - protein, 125 aa, Homo sapiens
  Payload ID: 15769
  Gene Symbol: STAT5A
  Gene Name: signal transducer and activator of transcription 5A
  ENSP ID: ENSP00000407327
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANN

SEQ ID NO: 79160 - protein, 764 aa, Homo sapiens
  Payload ID: 15769
  Gene Symbol: STAT5A
  Gene Name: signal transducer and activator of transcription 5A
  Uniprot ID: P42229
  ENSP ID: ENSP00000443107
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 79161 - protein, 141 aa, Homo sapiens
  Payload ID: 15769
  Gene Symbol: STAT5A
  Gene Name: signal transducer and activator of transcription 5A
  ENSP ID: ENSP00000464730
MSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQS

SEQ ID NO: 79162 - protein, 763 aa, Homo sapiens
  Payload ID: 15769
  Gene Symbol: STAT5A
  Gene Name: signal transducer and activator of transcription 5A
  ENSP ID: ENSP00000465437
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 79163 - protein, 229 aa, Homo sapiens
  Payload ID: 15769
  Gene Symbol: STAT5A
  Gene Name: signal transducer and activator of transcription 5A
  ENSP ID: ENSP00000466320
MKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQK

SEQ ID NO: 79164 - protein, 794 aa, Homo sapiens; identical to SEQ ID NO: 79158
  Payload ID: 15769
  Gene Symbol: STAT5A
  Gene Name: signal transducer and activator of transcription 5A
  Uniprot ID: P42229
  ENSP ID: ENSP00000468749

SEQ ID NO: 79165 - protein, 787 aa, Homo sapiens
  Payload ID: 15770
  Gene Symbol: STAT5B
  Gene Name: signal transducer and activator of transcription 5B
  Uniprot ID: P51692
  ENSP ID: ENSP00000293328
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATAKAVDGYVKPQIKQVVPEFVNASADAGGGSATYMDQAPSPAVCPQAHYNMYPQNPDSVLDTDGDFDLEDTMDVARRVEELLGRPMDSQWIPHAQS

SEQ ID NO: 79166 - protein, 156 aa, Homo sapiens
  Payload ID: 15770
  Gene Symbol: STAT5B
  Gene Name: signal transducer and activator of transcription 5B
  ENSP ID: ENSP00000398379
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQ

SEQ ID NO: 79167 - protein, 847 aa, Homo sapiens
  Payload ID: 15771
  Gene Symbol: STAT6
  Gene Name: signal transducer and activator of transcription 6, interleukin-4 induced
  Uniprot ID: P42226
  ENSP ID: ENSP00000300134
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 79168 - protein, 847 aa, Homo sapiens; identical to SEQ ID NO: 79167
  Payload ID: 15771
  Gene Symbol: STAT6
  Gene Name: signal transducer and activator of transcription 6, interleukin-4 induced
  Uniprot ID: P42226
  ENSP ID: ENSP00000401486

SEQ ID NO: 79169 - protein, 847 aa, Homo sapiens; identical to SEQ ID NO: 79167
  Payload ID: 15771
  Gene Symbol: STAT6
  Gene Name: signal transducer and activator of transcription 6, interleukin-4 induced
  Uniprot ID: P42226
  ENSP ID: ENSP00000438451

SEQ ID NO: 79170 - protein, 737 aa, Homo sapiens
  Payload ID: 15771
  Gene Symbol: STAT6
  Gene Name: signal transducer and activator of transcription 6, interleukin-4 induced
  Uniprot ID: P42226
  ENSP ID: ENSP00000444530
MEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 79171 - protein, 737 aa, Homo sapiens; identical to SEQ ID NO: 79170
  Payload ID: 15771
  Gene Symbol: STAT6
  Gene Name: signal transducer and activator of transcription 6, interleukin-4 induced
  Uniprot ID: P42226
  ENSP ID: ENSP00000445409

SEQ ID NO: 79172 - protein, 155 aa, Homo sapiens
  Payload ID: 15771
  Gene Symbol: STAT6
  Gene Name: signal transducer and activator of transcription 6, interleukin-4 induced
  ENSP ID: ENSP00000450428
IAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVCTHHTLTPSPRIKASPQKNQSTCCQPSRSLTCRCPPAW

SEQ ID NO: 79173 - protein, 38 aa, Homo sapiens
  Payload ID: 15771
  Gene Symbol: STAT6
  Gene Name: signal transducer and activator of transcription 6, interleukin-4 induced
  ENSP ID: ENSP00000450510
MSLWGLVSKMPPEKVQRLYVDFPQHLRHLLGDWLESQP

SEQ ID NO: 79174 - protein, 104 aa, Homo sapiens
  Payload ID: 15771
  Gene Symbol: STAT6
  Gene Name: signal transducer and activator of transcription 6, interleukin-4 induced
  ENSP ID: ENSP00000450665
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQ

SEQ ID NO: 79175 - protein, 64 aa, Homo sapiens
  Payload ID: 15771
  Gene Symbol: STAT6
  Gene Name: signal transducer and activator of transcription 6, interleukin-4 induced
  ENSP ID: ENSP00000450732
MSLWGLVSKMPPEKVQRLYVDFPQHLRHLLGDWLESQPWEFLVGSDAFCCNLASALLSDTVQHL

SEQ ID NO: 79176 - protein, 74 aa, Homo sapiens
  Payload ID: 15771
  Gene Symbol: STAT6
  Gene Name: signal transducer and activator of transcription 6, interleukin-4 induced
  ENSP ID: ENSP00000450747
MSLWGLVSKMPPEKVQRLYVDFPQHLRHLLGDWLESQPWEFLVGSDAFCCNLASALLSDTVQHLQASVGEQGEG

SEQ ID NO: 79177 - protein, 154 aa, Homo sapiens
  Payload ID: 15771
  Gene Symbol: STAT6
  Gene Name: signal transducer and activator of transcription 6, interleukin-4 induced
  ENSP ID: ENSP00000450921
MDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIEN

SEQ ID NO: 79178 - protein, 154 aa, Homo sapiens
  Payload ID: 15771
  Gene Symbol: STAT6
  Gene Name: signal transducer and activator of transcription 6, interleukin-4 induced
  ENSP ID: ENSP00000451074
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKG

SEQ ID NO: 79179 - protein, 103 aa, Homo sapiens
  Payload ID: 15771
  Gene Symbol: STAT6
  Gene Name: signal transducer and activator of transcription 6, interleukin-4 induced
  ENSP ID: ENSP00000451209
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQIL

SEQ ID NO: 79180 - protein, 290 aa, Homo sapiens
  Payload ID: 15771
  Gene Symbol: STAT6
  Gene Name: signal transducer and activator of transcription 6, interleukin-4 induced
  ENSP ID: ENSP00000451546
  MOD_RES (1)..(1): Any amino acid
XFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKMRNLMLRGLCSLFKFPKQEILLGRGFTFWQWFDGVLDLTKRCLRSYWSDRLIIGFISKQYVTSLLLNEPDGTFLLRFSDSEIGGI

SEQ ID NO: 79181 - protein, 847 aa, Homo sapiens; identical to SEQ ID NO: 79167
  Payload ID: 15771
  Gene Symbol: STAT6
  Gene Name: signal transducer and activator of transcription 6, interleukin-4 induced
  Uniprot ID: P42226
  ENSP ID: ENSP00000451742

SEQ ID NO: 79182 - protein, 38 aa, Homo sapiens; identical to SEQ ID NO: 79173
  Payload ID: 15771
  Gene Symbol: STAT6
  Gene Name: signal transducer and activator of transcription 6, interleukin-4 induced
  ENSP ID: ENSP00000451909

SEQ ID NO: 79183 - protein, 144 aa, Homo sapiens
  Payload ID: 15771
  Gene Symbol: STAT6
  Gene Name: signal transducer and activator of transcription 6, interleukin-4 induced
  ENSP ID: ENSP00000452203
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEI

SEQ ID NO: 79184 - protein, 141 aa, Homo sapiens
  Payload ID: 15771
  Gene Symbol: STAT6
  Gene Name: signal transducer and activator of transcription 6, interleukin-4 induced
  ENSP ID: ENSP00000452373
MSLWGLVSKMPPEKVQRLYVDFPQHLRHLLGDWLESQPWEFLVGSDAFCCNLASALLSDTVQHLQASSIYQRDPLKLVATFRQILQGEKKAVMEQFRHLPMPFHWKQEELKFKTGLRRLQHRVGEIHLLREALQKGAEAGQ

SEQ ID NO: 79185 - protein, 159 aa, Homo sapiens
  Payload ID: 15771
  Gene Symbol: STAT6
  Gene Name: signal transducer and activator of transcription 6, interleukin-4 induced
  ENSP ID: ENSP00000452394
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQ

SEQ ID NO: 79186 - protein, 295 aa, Homo sapiens
  Payload ID: 15772
  Gene Symbol: STAP1
  Gene Name: signal transducing adaptor family member 1
  Uniprot ID: Q9ULZ2
  ENSP ID: ENSP00000265404
MMAKKPPKPAPRRIFQERLKITALPLYFEGFLLIKRSGYREYEHYWTELRGTTLFFYTDKKSIIYVDKLDIVDLTCLTEQNSTEKNCAKFTLVLPKEEVQLKTENTESGEEWRGFILTVTELSVPQNVSLLPGQVIKLHEVLEREKKRRIETEQSTSVEKEKEPTEDYVDVLNPMPACFYTVSRKEATEMLQKNPSLGNMILRPGSDSRNYSITIRQEIDIPRIKHYKVMSVGQNYTIELEKPVTLPNLFSVIDYFVKETRGNLRPFICSTDENTGQEPSMEGRSEKLKKNPHIA

SEQ ID NO: 79187 - protein, 295 aa, Homo sapiens; identical to SEQ ID NO: 79186
  Payload ID: 15772
  Gene Symbol: STAP1
  Gene Name: signal transducing adaptor family member 1
  Uniprot ID: Q9ULZ2
  ENSP ID: ENSP00000379527

SEQ ID NO: 79188 - protein, 449 aa, Homo sapiens
  Payload ID: 15773
  Gene Symbol: STAP2
  Gene Name: signal transducing adaptor family member 2
  Uniprot ID: Q9UGK3
  ENSP ID: ENSP00000468927
MASALRPPRVPKPKGVLPSHYYESFLEKKGPCDRDYKKFWAGLQGLTIYFYNSNRDFQHVEKLNLGAFEKLTDEIPWGSSRDPGTHFSLILRDQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPVEKGFHHVAQAGLELLTSSDPPTSASQSAGITGVSHHTWPHLSSLPEPKVFNGGLGRKLPVSSAQPLFPTAGLADMTAELQKKLEKRRALEH

SEQ ID NO: 79189 - protein, 106 aa, Homo sapiens
  Payload ID: 15773
  Gene Symbol: STAP2
  Gene Name: signal transducing adaptor family member 2
  ENSP ID: ENSP00000469657
  MOD_RES (1)..(1): Any amino acid
XPGPGPAPCTGGPKPLSPASSQDKLPPLPPLPNQEENYVTPIGDGPAVDYENQDVASSSWPVILKPKKLPKPPAKLPKPPVGPKPGLADMTAELQKKLEKRRALEH

SEQ ID NO: 79190 - protein, 105 aa, Homo sapiens
  Payload ID: 15773
  Gene Symbol: STAP2
  Gene Name: signal transducing adaptor family member 2
  ENSP ID: ENSP00000470321
MASALRPPRVPKPKGVLPSHYYESFLEKKGPCDRPRKNSVNLSCWGEGQDRITRSSGQACRVSPFISTIAIGTSSTWRSSTWEHLRNSQMRFPGEAHVTLAPTSA

SEQ ID NO: 79191 - protein, 403 aa, Homo sapiens
  Payload ID: 15773
  Gene Symbol: STAP2
  Gene Name: signal transducing adaptor family member 2
  Uniprot ID: Q9UGK3
  ENSP ID: ENSP00000471052
MASALRPPRVPKPKGVLPSHYYESFLEKKGPCDRDYKKFWAGLQGLTIYFYNSNRDFQHVEKLNLGAFEKLTDEIPWGSSRDPGTHFSLILRDQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPEPKVFNGGLGRKLPVSSAQPLFPTAGLADMTAELQKKLEKRRALEH

SEQ ID NO: 79192 - protein, 159 aa, Homo sapiens
  Payload ID: 15773
  Gene Symbol: STAP2
  Gene Name: signal transducing adaptor family member 2
  ENSP ID: ENSP00000471281
  MOD_RES (1)..(1): Any amino acid
XLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPEPKVFNGGLGRKLPVSSAQPLFPTAGLADMTAELQKKLEKRRALEH

SEQ ID NO: 79193 - protein, 260 aa, Homo sapiens
  Payload ID: 15773
  Gene Symbol: STAP2
  Gene Name: signal transducing adaptor family member 2
  ENSP ID: ENSP00000472851
MASALRPPRVPKPKGVLPSHYYESFLEKKGPCDRDYKKFWAGLQGLTIYFYNSNRDFQHVEKLNLGAFEKLTDEIPWGSSRDPGTHFSLILRDQEIKFKVETLECREMWKGFILTVVELRVPTDLTLLPGHLYMMSEVLAKEEARRALETPSTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPN

SEQ ID NO: 79194 - protein, 173 aa, Homo sapiens
  Payload ID: 15774
  Gene Symbol: STAM
  Gene Name: signal transducing adaptor molecule (SH3 domain and ITAM motif) 1
  ENSP ID: ENSP00000366721
MVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQF

SEQ ID NO: 79195 - protein, 540 aa, Homo sapiens
  Payload ID: 15774
  Gene Symbol: STAM
  Gene Name: signal transducing adaptor molecule (SH3 domain and ITAM motif) 1
  Uniprot ID: Q92783
  ENSP ID: ENSP00000366746
MPLFATNPFDQDVEKATSEMNTAEDWGLILDICDKVGQSRTGPKDCLRSIMRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 79196 - protein, 42 aa, Homo sapiens
  Payload ID: 15774
  Gene Symbol: STAM
  Gene Name: signal transducing adaptor molecule (SH3 domain and ITAM motif) 1
  ENSP ID: ENSP00000400025
MPLFATNPFDQDVEKATSEMNTAEDWGLILDICDKVGQSRTG

SEQ ID NO: 79197 - protein, 525 aa, Homo sapiens [sequence omitted]

SEQ ID NO: 79198 - protein, 1042 aa, Homo sapiens
  Payload ID: 15776
  Gene Symbol: SIPA1
  Gene Name: signal-induced proliferation-associated 1
  Uniprot ID: Q96FS4
  ENSP ID: ENSP00000377771
MPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEVTTTSLDSASRFGLPSLGGRRRAAPRGPGAELQAAGSLVWGVRAAPGARVAAGAQASGPEGIEVPCLLGISAEALVLVAPRDGRVVFNCACRDVLAWTFSEQQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 79199 - protein, 1042 aa, Homo sapiens; identical to SEQ ID NO: 79198
  Payload ID: 15776
  Gene Symbol: SIPA1
  Gene Name: signal-induced proliferation-associated 1
  Uniprot ID: Q96FS4
  ENSP ID: ENSP00000377774

SEQ ID NO: 79200 - protein, 940 aa, Homo sapiens
  Payload ID: 15776
  Gene Symbol: SIPA1
  Gene Name: signal-induced proliferation-associated 1
  ENSP ID: ENSP00000433686
MPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEEPEPAFPPVLEPRWFAHYDVQSLLFDWAPRSQGMGSHSEASSGTLASAEDQAASSDLLHGAPGFVCELGGEGELGLGGPASPPVPPALPNAAVSILEEPQNRTSAYSLEHADLGAGYYRKYFYGKEHQNFFGMDESLGPVAVSLRREEKEGSGGGTLHSYRVIVRTTQLRTLRGTISEDALPPGPPRGLSPRKLLEHVAPQLSPSCLRLGSASPKVPRTLLTLDEQVLSFQRKVGILYCRAGQGSEEEMYNNQEAGPAFMQFLTLLGDVVRLKGFESYRAQLDTKTDSTGTHSLYTTYQDHEIMFHVSTMLPYTPNNQQQLLRKRHIGNDIVTIVFQEPGSKPFCPTTIRSHFQHVFLVVRAHTPCTPHTTYRVAVSRTQDTPAFGPALPAGGGPFAANADFRAFLLAKALNGEQAAGHARQFHAMATRTRQQYLQDLATNEQLDLYHGRGEAITLRFDGSPGQAVGEVVARLQLVSRGCETRELALPRDGQGRLGFEVDAEGFVTHVERFTFAETAGLRPGARLLRVCGQTLPSLRPEAAAQLLRSAPKVCVTVLPPDESGRPRRSFSELYTLSLQEPSRRGAPDPVQDEVQGVTLLPTTKQLLHLCLQDGGSPPGPGDLAEERTEFLHSQNSLSPRSSLSDEAPVLPNTTPDLLLATTAKPSVPSADSETPLTQDRPGSPSGSEDKGNPAPELRASFLPRTLSLRNSISRIMSEAGSGTLEDEWQAISEIASTCNTILESLSREGQPIPESGDPKGTPKSDAEPEPGNLSEKVSHLESMLRKLQEDLQKEKADRAALEEEVRSLRHNNRRLQAESESAATRLLLASKQLGSPTADLA

SEQ ID NO: 79201 - protein, 6 aa, Homo sapiens
  Payload ID: 15776
  Gene Symbol: SIPA1
  Gene Name: signal-induced proliferation-associated 1
  ENSP ID: ENSP00000434362
MPMWAG

SEQ ID NO: 79202 - protein, 1042 aa, Homo sapiens; identical to SEQ ID NO: 79198
  Payload ID: 15776
  Gene Symbol: SIPA1
  Gene Name: signal-induced proliferation-associated 1
  Uniprot ID: Q96FS4
  ENSP ID: ENSP00000436269

SEQ ID NO: 79203 - protein, 102 aa, Homo sapiens
  Payload ID: 15776
  Gene Symbol: SIPA1
  Gene Name: signal-induced proliferation-associated 1
  ENSP ID: ENSP00000436683
MPMWAGGVGSPRRGMAPASTDDLFARKLRQPARPPLTPHTFEPRPVRGPLLRSGSDAGEARPPTPASPRARAHSHEEASRPAATSTRLFTDPLALLGLPAEE

SEQ ID NO: 79204 - protein, 940 aa, Homo sapiens; identical to SEQ ID NO: 79200
  Payload ID: 15776
  Gene Symbol: SIPA1
  Gene Name: signal-induced proliferation-associated 1
  ENSP ID: ENSP00000485899

SEQ ID NO: 79205 - protein, 1782 aa, Homo sapiens
  Payload ID: 15777
  Gene Symbol: SIPA1L1
  Gene Name: signal-induced proliferation-associated 1 like 1
  Uniprot ID: O43166
  ENSP ID: ENSP00000351352
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSKDSSPTLASKVDQLEGMLKMLREDLKKEKEDKAHLQAEVQHLREDNLRLQEESQNASDKLKKFTEWVFNTIDMS

SEQ ID NO: 79206 - protein, 1783 aa, Homo sapiens
  Payload ID: 15777
  Gene Symbol: SIPA1L1
  Gene Name: signal-induced proliferation-associated 1 like 1
  Uniprot ID: O43166
  ENSP ID: ENSP00000370630
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 79207 - protein, 1257 aa, Homo sapiens
  Payload ID: 15777
  Gene Symbol: SIPA1L1
  Gene Name: signal-induced proliferation-associated 1 like 1
  ENSP ID: ENSP00000440682
MKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSKDSSPTLASKVDQLEGMLKMLREDLKKEKEDKAHLQAEVQHLREDNLRLQEESQNASDKLKKFTEWVFNTIDMS

SEQ ID NO: 79208 - protein, 1804 aa, Homo sapiens
  Payload ID: 15777
  Gene Symbol: SIPA1L1
  Gene Name: signal-induced proliferation-associated 1 like 1
  Uniprot ID: O43166
  ENSP ID: ENSP00000450832
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMAYSYRGPQDFNSFVLEQHEYTEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 79209 - protein, 32 aa, Homo sapiens
  Payload ID: 15777
  Gene Symbol: SIPA1L1
  Gene Name: signal-induced proliferation-associated 1 like 1
  ENSP ID: ENSP00000452080
MTSLKRSQTERPLATDRASVVGTDGTPKVHTD

SEQ ID NO: 79210 - protein, 261 aa, Homo sapiens
  Payload ID: 15777
  Gene Symbol: SIPA1L1
  Gene Name: signal-induced proliferation-associated 1 like 1
  ENSP ID: ENSP00000452450
EHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGWICLYLYASYYLPSQLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPC

SEQ ID NO: 79211 - protein, 1722 aa, Homo sapiens
  Payload ID: 15778
  Gene Symbol: SIPA1L2
  Gene Name: signal-induced proliferation-associated 1 like 2
  Uniprot ID: Q9P2F8
  ENSP ID: ENSP00000262861
MSDPRQSQEEKHKLGRASSKFKDPPRIMQSDDYFARKFKAINGNMGPTTSLNASNSNETGGGGPANGTPAVPKMGVRARVSEWPPKKDCSKELTCKALWESRSQTSYESITSVLQNGQSDQSEGQQDEQLDLDFVEAKYTIGDIFVHSPQRGLHPIRQRSNSDVTISDIDAEDVLDQNAVNPNTGAALHREYGSTSSIDRQGLSGENFFAMLRGYRVENYDHKAMVPFGFPEFFRCDPAISPSLHAAAQISRGEFVRISGLDYVDSALLMGRDRDKPFKRRLKSESVETSLFRKLRTVKSEHETFKFTSELEESRLERGIRPWNCQRCFAHYDVQSILFNINEAMATRANVGKRKNITTGASAASQTQMPTGQTGNCESPLGSKEDLNSKENLDADEGDGKSNDLVLSCPYFRNETGGEGDRRIALSRANSSSFSSGESCSFESSLSSHCTNAGVSVLEVPRENQPIHREKVKRYIIEHIDLGAYYYRKFFYGKEHQNYFGIDENLGPVAVSIRREKVEDAKEKEGSQFNYRVAFRTSELTTLRGAILEDAIPSTARHGTARGLPLKEVLEYVIPELSIQCLRQASNSPKVSEQLLKLDEQGLSFQHKIGILYCKAGQSTEEEMYNNETAGPAFEEFLDLLGQRVRLKGFSKYRAQLDNKTDSTGTHSLYTTYKDYELMFHVSTLLPYMPNNRQQLLRKRHIGNDIVTIVFQEPGALPFTPKSIRSHFQHVFVIVKVHNPCTENVCYSVGVSRSKDVPPFGPPIPKGVTFPKSAVFRDFLLAKVINAENAAHKSEKFRAMATRTRQEYLKDLAENFVTTATVDTSVKFSFITLGAKKKEKVKPRKDAHLFSIGAIMWHVIARDFGQSADIECLLGISNEFIMLIEKDSKNVVFNCSCRDVIGWTSGLVSIKVFYERGECVLLSSVDNCAEDIREIVQRLVIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEGLDSDEELGLLCHHTSYLDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKS

SEQ ID NO: 79212 - protein, 778 aa, Homo sapiens
  Payload ID: 15778
  Gene Symbol: SIPA1L2
  Gene Name: signal-induced proliferation-associated 1 like 2
  Uniprot ID: Q9P2F8
  ENSP ID: ENSP00000309102
MSPCFSFIGCKLCSIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKS

SEQ ID NO: 79213 - protein, 1722 aa, Homo sapiens; identical to SEQ ID NO: 79211
  Payload ID: 15778
  Gene Symbol: SIPA1L2
  Gene Name: signal-induced proliferation-associated 1 like 2
  Uniprot ID: Q9P2F8
  ENSP ID: ENSP00000355589

SEQ ID NO: 79214 - protein, 1781 aa, Homo sapiens
  Payload ID: 15779
  Gene Symbol: SIPA1L3
  Gene Name: signal-induced proliferation-associated 1 like 3
  Uniprot ID: O60292
  ENSP ID: ENSP00000222345
MTTYRAIPSDGVDLAASCGARVGDVLPGPHTGDYAPLGFWAQNGSMSQPLGESPATATATATATTRPSPTTPAMPKMGVRARVADWPPKREALREHSNPSPSQDTDGTKATKMAHSMRSIQNGQPPTSTPASSGSKAFHRLSRRRSKDVEFQDGWPRSPGRAFLPLRHRSSSEITLSECDAEDAGEPRGARHTGALPLFREYGSTSSIDVQGMPEQSFFDILNEFRSEQPDARGCQALTELLRADPGPHLMGGGGGAKGDSHNGQPAKDSLLPLQPTKEKEKARKKPARGLGGGDTVDSSIFRKLRSSKPEGEAGRSPGEADEGRSPPEASRPWVCQKSFAHFDVQSMLFDLNEAAANRVSVSQRRNTTTGASAASAASAMASLTASRAHSLGGLDPAFTSTEDLNCKENLEQDLGDDNSNDLLLSCPHFRNEIGGECERNVSFSRASVGSPSSGEGHLAEPALSAYRTNASISVLEVPKEQQRTQSRPRQYSIEHVDLGARYYQDYFVGKEHANYFGVDEKLGPVAVSIKREKLEDHKEHGPQYQYRIIFRTRELITLRGSILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKTDSTGTHSLYTMYQDYEIMFHVSTLLPYTPNNRQQLLRKRHIGNDIVTIIFQEPGALPFTPKNIRSHFQHVFIIVRVHNPCTDNVCYSMAVTRSKDAPPFGPPIPSGTTFRKSDVFRDFLLAKVINAENAAHKSDKFHTMATRTRQEYLKDLAENCVSNTPIDSTGKFNLISLTSKKKEKTKARAGAEQHSAGAIAWRVVAQDYAQGVEIDCILGISNEFVVLLDLRTKEVVFNCYCGDVIGWTPDSSTLKIFYGRGDHIFLQATEGSVEDIREIVQRLKVMTSGWETVDMTLRRNGLGQLGFHVKYDGTVAEVEDYGFAWQAGLRQGSRLVEICKVAVVTLTHDQMIDLLRTSVTVKVVIIPPFEDGTPRRGWPETYDMNTSEPKTEQESITPGGRPPYRSNAPWQWSGPASHNSLPASKWATPTTPGHAQSLSRPLKQTPIVPFRESQPLHSKRPVSFPETPYTVSPAGADRVPPYRQPSGSFSTPGSATYVRYKPSPERYTAAPHPLLSLDPHFSHDGTSSGDSSSGGLTSQESTMERQKPEPLWHVPAQARLSAIAGSSGNKHPSRQDAAGKDSPNRHSKGEPQYSSHSSSNTLSSNASSSHSDDRWFDPLDPLEPEQDPLSKGGSSDSGIDTTLYTSSPSCMSLAKAPRPAKPHKPPGSMGLCGGGREAAGRSHHADRRREVSPAPAVAGQSKGYRPKLYSSGSSTPTGLAGGSRDPPRQPSDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGQSPQKGLQRTLSDESLCSGRREPSFASPAGLEPGLPSDVLFTSTCAFPSSTLPARRQHQHPHPPVGPGATPAAGSGFPEKKSTISASELSLADGRDRPLRRLDPGLMPLPDTAAGLEWSSLVNAAKAYEVQRAVSLFSLNDPALSPDIPPAHSPVHSHLSLERGPPTPRTTPTMSEEPPLDLTGKVYQLEVMLKQLHTDLQKEKQDKVVLQSEVASLRQNNQRLQEESQAASEQLRKFAEIFCREKKEL

SEQ ID NO: 79215 - protein, 165 aa, Homo sapiens
  Payload ID: 15779
  Gene Symbol: SIPA1L3
  Gene Name: signal-induced proliferation-associated 1 like 3
  ENSP ID: ENSP00000468981
  MOD_RES (1)..(1): Any amino acid
XILEDATPTATKHGTGRGLPLKDALEYVIPELNIHCLRLALNTPKVTEQLLKLDEQGLCRKHKVGILYCKAGQSSEEEMYNNEEAGPAFEEFLSLIGEKVCLKGFTKYAAQLDVKIETGFHHVGQAGLELLTSDDPPASASQSAGIIGVNHQAWPVYLIFKSRLK

SEQ ID NO: 79216 - protein, 184 aa, Homo sapiens
  Payload ID: 15779
  Gene Symbol: SIPA1L3
  Gene Name: signal-induced proliferation-associated 1 like 3
  ENSP ID: ENSP00000472734
MPFWGHSPESDMGSRVGYPAQVYKTASAETPRPSQLAQPSPFQLSASVPKSFFSKQPVRNKHPTGWKRTEEPPPRPLPFSDPKKQVDTNTKNVFGQPRLRASLRDLRSPRKNYKSTIEDDLKKLIIMDNLGPEQERDTGSPQKGLQRTLSDESLCSGRREPSFASPAGLEPGLPSDVLFTSTCA

SEQ ID NO: 79217 - protein, 144 aa, Homo sapiens
  Payload ID: 15780
  Gene Symbol: SLAMF1
  Gene Name: signaling lymphocytic activation molecule family member 1
  ENSP ID: ENSP00000235739
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKSLHFGYLYFVLGADHDNLQT

SEQ ID NO: 79218 - protein, 335 aa, Homo sapiens
  Payload ID: 15780
  Gene Symbol: SLAMF1
  Gene Name: signaling lymphocytic activation molecule family member 1
  Uniprot ID: Q13291
  ENSP ID: ENSP00000306190
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 79219 - protein, 357 aa, Homo sapiens
  Payload ID: 15780
  Gene Symbol: SLAMF1
  Gene Name: signaling lymphocytic activation molecule family member 1
  ENSP ID: ENSP00000438406
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRATLTTTNQYWSQNVLTQDQERCPGCLPMVKRTITRQQWKKKALRSMPKSRNQVLFRRNLTPSQLRTLAPPYMLLPQSLSQSLSRKQIPSQSMLV

SEQ ID NO: 79220 - protein, 196 aa, Homo sapiens
  Payload ID: 15781
  Gene Symbol: SIT1
  Gene Name: signaling threshold regulating transmembrane adaptor 1
  Uniprot ID: Q9Y3P8
  ENSP ID: ENSP00000259608
MNQADPRLRAVCLWTLTSAAMSRGDNCTDLLALGIPSITQAWGLWVLLGAVTLLFLISLAAHLSQWTRGRSRSHPGQGRSGESVEEVPLYGNLHYLQTGRLSQDPEPDQQDPTLGGPARAAEEVMCYTSLQLRPPQGRIPGPGTPVKYSEVVLDSEPKSQASGPEPELYASVCAQTRRARASFPDQAYANSQPAAS

SEQ ID NO: 79221 - protein, 224 aa, Homo sapiens
  Payload ID: 15781
  Gene Symbol: SIT1
  Gene Name: signaling threshold regulating transmembrane adaptor 1
  ENSP ID: ENSP00000481347
MNQADPRLRAVCLWTLTSAAMSRGDNCTDLLALGIPSITQAWGLWVLLGAVTLLFLISLAAHLSQWTRGRSRSHPGQGRWVKDNRDGLTESSLLPRSPHSSPKLCVASGESVEEVPLYGNLHYLQTGRLSQDPEPDQQDPTLGGPARAAEEVMCYTSLQLRPPQGRIPGPGTPVKYSEVVLDSEPKSQASGPEPELYASVCAQTRRARASFPDQAYANSQPAAS

SEQ ID NO: 79222 - protein, 504 aa, Homo sapiens
  Payload ID: 15782
  Gene Symbol: SIRPA
  Gene Name: signal-regulatory protein alpha
  Uniprot ID: P78324
  ENSP ID: ENSP00000348307
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 79223 - protein, 504 aa, Homo sapiens; identical to SEQ ID NO: 79222
  Payload ID: 15782
  Gene Symbol: SIRPA
  Gene Name: signal-regulatory protein alpha
  Uniprot ID: P78324
  ENSP ID: ENSP00000351621

SEQ ID NO: 79224 - protein, 504 aa, Homo sapiens; identical to SEQ ID NO: 79222
  Payload ID: 15782
  Gene Symbol: SIRPA
  Gene Name: signal-regulatory protein alpha
  Uniprot ID: P78324
  ENSP ID: ENSP00000382941

SEQ ID NO: 79225 - protein, 508 aa, Homo sapiens
  Payload ID: 15782
  Gene Symbol: SIRPA
  Gene Name: signal-regulatory protein alpha
  Uniprot ID: P78324
  ENSP ID: ENSP00000478763
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQVQSLDTNDITYADLNLPKGKKPAPQAAEPNNHTEYASIQTSPQPASEDTLTYADLDMVHLNRTPKQPAPKPEPSFSEYASVQVPRK

SEQ ID NO: 79226 - protein, 180 aa, Homo sapiens
  Payload ID: 15783
  Gene Symbol: SIRPB1
  Gene Name: signal-regulatory protein beta 1
  ENSP ID: ENSP00000262929
MPVPASWPHPPCPFLLLTLLLGLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVREAALAPTAPLLVALLLGPKLLLVVGVSAIYICWKQKA

SEQ ID NO: 79227 - protein, 398 aa, Homo sapiens
  Payload ID: 15783
  Gene Symbol: SIRPB1
  Gene Name: signal-regulatory protein beta 1
  Uniprot ID: Q5TFQ8
  ENSP ID: ENSP00000279477
MPVPASWPHLPSPFLLMTLLLGRLTGVAGEEELQVIQPDKSISVAAGESATLHCTVTSLIPVGPIQWFRGAGPGRELIYNQKEGHFPRVTTVSDLTKRNNMDFSIRISNITPADAGTYYCVKFRKGSPDHVEFKSGAGTELSVRAKPSAPVVSGPAARATPQHTVSFTCESHGFSPRDITLKWFKNGNELSDFQTNVDPAGDSVSYSIHSTAKVVLTREDVHSQVICEVAHVTLQGDPLRGTANLSETIRVPPTLEVTQQPVRAENQVNVTCQVRKFYPQRLQLTWLENGNVSRTETASTLTENKDGTYNWMSWLLVNVSAHRDDVKLTCQVEHDGQPAVSKSHDLKVSAHPKEQGSNTAPGPALASAAPLLIAFLLGPKVLLVVGVSVIYVYWKQKA

SEQ ID NO: 79228 - protein, 181 aa, Homo sapiens
  Payload ID: 15783
  Gene Symbol: SIRPB1
  Gene Name: signal-regulatory protein beta 1
  Uniprot ID: O00241
  ENSP ID: ENSP00000371016
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVREAALAPTAPLLVALLLGPKLLLVVGVSAIYICWKQKA

SEQ ID NO: 79229 - protein, 398 aa, Homo sapiens
  Payload ID: 15783
  Gene Symbol: SIRPB1
  Gene Name: signal-regulatory protein beta 1
  Uniprot ID: O00241
  ENSP ID: ENSP00000371018
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRAKPSAPVVSGPAVRATPEHTVSFTCESHGFSPRDITLKWFKNGNELSDFQTNVDPAGDSVSYSIHSTARVVLTRGDVHSQVICEIAHITLQGDPLRGTANLSEAIRVPPTLEVTQQPMRAENQANVTCQVSNFYPRGLQLTWLENGNVSRTETASTLIENKDGTYNWMSWLLVNTCAHRDDVVLTCQVEHDGQQAVSKSYALEISAHQKEHGSDITHEAALAPTAPLLVALLLGPKLLLVVGVSAIYICWKQKA

SEQ ID NO: 79230 - protein, 236 aa, Homo sapiens
  Payload ID: 15783
  Gene Symbol: SIRPB1
  Gene Name: signal-regulatory protein beta 1
  ENSP ID: ENSP00000455568
HTVSFTCESHGFSPRDITLKWFKNGNELSDFQTNVDPAGDSVSYSIHSTAKVVLTREDVHSQVICEVAHVTLQGDPLRGTANLSETIRVPPTLEVTQQPVRAENQVNVTCQVRKFYPQRLQLTWLENGNVSRTETASTLTENKDGTYNWMSWLLVNVSAHRDDVKLTCQVEHDGQPAVSKSHDLKVSAHPKEQGSNTAPGPALASAAPLLIAFLLGPKVLLVVGVSVIYVYWKQKA

SEQ ID NO: 79231 - protein, 156 aa, Homo sapiens
  Payload ID: 15783
  Gene Symbol: SIRPB1
  Gene Name: signal-regulatory protein beta 1
  ENSP ID: ENSP00000456351
MPVPASWPHPPCPFLLLTLLLGLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVREAALAPTAPLLVA

SEQ ID NO: 79232 - protein, 77 aa, Homo sapiens
  Payload ID: 15783
  Gene Symbol: SIRPB1
  Gene Name: signal-regulatory protein beta 1
  ENSP ID: ENSP00000456519
HRDDVKLTCQVEHDGQPAVSKSHDLKVSAHPKEQGSNTAPGPALASAAPLLIAFLLGPKVLLVVGVSVIYVYWKQKA

SEQ ID NO: 79233 - protein, 131 aa, Homo sapiens
  Payload ID: 15783
  Gene Symbol: SIRPB1
  Gene Name: signal-regulatory protein beta 1
  ENSP ID: ENSP00000456747
  MOD_RES (1)..(1): Any amino acid
XPPTLEVTQQPVRAENQVNVTCQVRKFYPQRLQLTWLENGNVSRTETASTLTENKDGTYNWMSWLLVNVSAHRDDVKLTCQVEHDGQPAVSKSHDLKVSAHPKEQGSNTAPVSLEFYRRGNQDLGSNGGYC

SEQ ID NO: 79234 - protein, 398 aa, Homo sapiens; identical to SEQ ID NO: 79227
  Payload ID: 15783
  Gene Symbol: SIRPB1
  Gene Name: signal-regulatory protein beta 1
  Uniprot ID: Q5TFQ8
  ENSP ID: ENSP00000456826

SEQ ID NO: 79235 - protein, 58 aa, Homo sapiens
  Payload ID: 15783
  Gene Symbol: SIRPB1
  Gene Name: signal-regulatory protein beta 1
  ENSP ID: ENSP00000457323
RKGSPDHVEFKSGAGTELSVREAALAPTAPLLVALLLGPKLLLVVGVSAIYICWKQKA

SEQ ID NO: 79236 - protein, 77 aa, Homo sapiens; identical to SEQ ID NO: 79232
  Payload ID: 15783
  Gene Symbol: SIRPB1
  Gene Name: signal-regulatory protein beta 1
  ENSP ID: ENSP00000457458

SEQ ID NO: 79237 - protein, 182 aa, Homo sapiens
  Payload ID: 15783
  Gene Symbol: SIRPB1
  Gene Name: signal-regulatory protein beta 1
  ENSP ID: ENSP00000457829
GNELSDFQTNVDPAGDSVSYSIHSTARVVLTRGDVHSQVICEIAHITLQGDPLRGTANLSEAIRVPPTLEVTQQPMRAENQANVTCQVSNFYPRGLQLTWLENGNVSRTETASTLIENKDGTYNWMSWLLVNTCAHRDDVVLTCQVEHDGQQAVSKSYALEISAHQKEHGSDITHGAVTSHF

SEQ ID NO: 79238 - protein, 77 aa, Homo sapiens; identical to SEQ ID NO: 79232
  Payload ID: 15783
  Gene Symbol: SIRPB1
  Gene Name: signal-regulatory protein beta 1
  ENSP ID: ENSP00000457855

SEQ ID NO: 79239 - protein, 342 aa, Homo sapiens
  Payload ID: 15784
  Gene Symbol: SIRPB2
  Gene Name: signal-regulatory protein beta 2
  Uniprot ID: Q5JXA9
  ENSP ID: ENSP00000352849
MCSTMSAPTCLAHLPPCFLLLALVLVPSDASGQSSRNDWQVLQPEGPMLVAEGETLLLRCMVVGSCTDGMIKWVKVSTQDQQEIYNFKRGSFPGVMPMIQRTSEPLNCDYSIYIHNVTREHTGTYHCVRFDGLSEHSEMKSDEGTSVLVKGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKAKSTSSKEAEFTSEPATEMSPTGLLVVFAPVVLGLKAITLAALLLALATSRRSPGQEDVKTTGPAGAMNTLAWSKGQE

SEQ ID NO: 79240 - protein, 244 aa, Homo sapiens
  Payload ID: 15784
  Gene Symbol: SIRPB2
  Gene Name: signal-regulatory protein beta 2
  Uniprot ID: Q5JXA9
  ENSP ID: ENSP00000402438
MCSTMSAPTCLAHLPPCFLLLALVLVPSDASGQSSRNDWQVLQPEGPMLVAEGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKAKSTSSKEAEFTSEPATEMSPTGLLVVFAPVVLGLKAITLAALLLALATSRRSPGQEDVKTTGPAGAMNTLAWSKGQE

SEQ ID NO: 79241 - protein, 289 aa, Homo sapiens
  Payload ID: 15784
  Gene Symbol: SIRPB2
  Gene Name: signal-regulatory protein beta 2
  ENSP ID: ENSP00000432656
MCSTMSAPTCLAHLPPCFLLLALVLVPSDASGQSSRNDWQVLQPEGPMLVAEGETLLLRCMVVGSCTDGMIKWVKVSTQDQQEIYNFKRGSFPGVMPMIQRTSEPLNCDYSIYIHNVTREHTGTYHCVRFDGLSEHSEMKSDEGTSVLVKGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKAKSTSSKEAEFTSEPATEMSPTGLQ

SEQ ID NO: 79242 - protein, 289 aa, Homo sapiens; identical to SEQ ID NO: 79241
  Payload ID: 15784
  Gene Symbol: SIRPB2
  Gene Name: signal-regulatory protein beta 2
  ENSP ID: ENSP00000435045

SEQ ID NO: 79243 - protein, 86 aa, Homo sapiens
  Payload ID: 15784
  Gene Symbol: SIRPB2
  Gene Name: signal-regulatory protein beta 2
  ENSP ID: ENSP00000477149
MCSTMSAPTCLAHLPPCFLLLALVLVPSDASGQSSRNDWQVLQPEGPMLVAEGETLLLRCMVVGSCTDGMIKWVKGAHWNLPLCEV

SEQ ID NO: 79244 - protein, 198 aa, Homo sapiens
  Payload ID: 15785
  Gene Symbol: SIRPD
  Gene Name: signal-regulatory protein delta
  ENSP ID: ENSP00000371034
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTAEQNPRPPKNRPAGRAGSRAHHDAHTCLSALPERNSTNYFVQPCCCLRLLGLTGLLSK

SEQ ID NO: 79245 - protein, 197 aa, Homo sapiens
  Payload ID: 15785
  Gene Symbol: SIRPD
  Gene Name: signal-regulatory protein delta
  Uniprot ID: Q9H106
  ENSP ID: ENSP00000371036
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTEQNPRPPKNRPAGRAGSRAHHDAHTCLSALPERNSTNYFVQPCCCLRLLGLTGLLSK

SEQ ID NO: 79246 - protein, 80 aa, Homo sapiens
  Payload ID: 15785
  Gene Symbol: SIRPD
  Gene Name: signal-regulatory protein delta
  ENSP ID: ENSP00000410072
  MOD_RES (1)..(1): Any amino acid
XNGPVLWFKGTGPNRKLIYNFKQEQNPRPPKNRPAGRAGSRAHHDAHTCLSALPERNSTNYFVQPCCCLRLLGLTGLLSK

SEQ ID NO: 79247 - protein, 276 aa, Homo sapiens
  Payload ID: 15786
  Gene Symbol: SIRPG
  Gene Name: signal-regulatory protein gamma
  Uniprot ID: Q9P1W8
  ENSP ID: ENSP00000216927
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRGPASSLTALLLIAVLLGPIYVPWKQKT

SEQ ID NO: 79248 - protein, 387 aa, Homo sapiens
  Payload ID: 15786
  Gene Symbol: SIRPG
  Gene Name: signal-regulatory protein gamma
  Uniprot ID: Q9P1W8
  ENSP ID: ENSP00000305529
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRVPPTLEVTQQPMRVGNQVNVTCQVRKFYPQSLQLTWSENGNVCQRETASTLTENKDGTYNWTSWFLVNISDQRDDVVLTCQVKHDGQLAVSKRLALEVTVHQKDQSSDATPGPASSLTALLLIAVLLGPIYVPWKQKT

SEQ ID NO: 79249 - protein, 170 aa, Homo sapiens
  Payload ID: 15786
  Gene Symbol: SIRPG
  Gene Name: signal-regulatory protein gamma
  Uniprot ID: Q9P1W8
  ENSP ID: ENSP00000342759
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGGPASSLTALLLIAVLLGPIYVPWKQKT

SEQ ID NO: 79250 - protein, 354 aa, Homo sapiens
  Payload ID: 15786
  Gene Symbol: SIRPG
  Gene Name: signal-regulatory protein gamma
  Uniprot ID: Q9P1W8
  ENSP ID: ENSP00000370992
MIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRVPPTLEVTQQPMRVGNQVNVTCQVRKFYPQSLQLTWSENGNVCQRETASTLTENKDGTYNWTSWFLVNISDQRDDVVLTCQVKHDGQLAVSKRLALEVTVHQKDQSSDATPGPASSLTALLLIAVLLGPIYVPWKQKT

SEQ ID NO: 79251 - protein, 276 aa, Homo sapiens; identical to SEQ ID NO: 79247
  Payload ID: 15786
  Gene Symbol: SIRPG
  Gene Name: signal-regulatory protein gamma
  Uniprot ID: Q9P1W8
  ENSP ID: ENSP00000370995

SEQ ID NO: 79252 - protein, 1321 aa, Homo sapiens
  Payload ID: 15787
  Gene Symbol: SIK3
  Gene Name: SIK family kinase 3
  ENSP ID: ENSP00000364449
MAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQSSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 79253 - protein, 1261 aa, Homo sapiens
  Payload ID: 15787
  Gene Symbol: SIK3
  Gene Name: SIK family kinase 3
  ENSP ID: ENSP00000390442
MAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 79254 - protein, 1363 aa, Homo sapiens
  Payload ID: 15787
  Gene Symbol: SIK3
  Gene Name: SIK family kinase 3
  ENSP ID: ENSP00000391295
  MOD_RES (1)..(1): Any amino acid
XGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQRYLANRSKRHTLAMTNPTAEIPPDLQRQLGQQPFRSRVWPPHLVPDQHRSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 79255 - protein, 151 aa, Homo sapiens
  Payload ID: 15787
  Gene Symbol: SIK3
  Gene Name: SIK family kinase 3
  ENSP ID: ENSP00000392761
RPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFGGFGHQQFSFCPELPIAESWRSAVKRWGPLLLLSPHLWNLIRPPGGPW

SEQ ID NO: 79256 - protein, 71 aa, Homo sapiens
  Payload ID: 15787
  Gene Symbol: SIK3
  Gene Name: SIK family kinase 3
  ENSP ID: ENSP00000392849
  MOD_RES (1)..(1): Any amino acid
XNSDDAYVQLDNLPGMSLVAGKALSSARMSDAVLSQSSLMGSQQFQDGENEDILLSYKHPEVSFSMEQAGV

SEQ ID NO: 79257 - protein, 506 aa, Homo sapiens
  Payload ID: 15787
  Gene Symbol: SIK3
  Gene Name: SIK family kinase 3
  ENSP ID: ENSP00000414347
  MOD_RES (1)..(1): Any amino acid
XKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQR

SEQ ID NO: 79258 - protein, 461 aa, Homo sapiens
  Payload ID: 15788
  Gene Symbol: SIL1
  Gene Name: SIL1 nucleotide exchange factor
  Uniprot ID: Q9H173
  ENSP ID: ENSP00000265195
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 79259 - protein, 461 aa, Homo sapiens; identical to SEQ ID NO: 79258
  Payload ID: 15788
  Gene Symbol: SIL1
  Gene Name: SIL1 nucleotide exchange factor
  Uniprot ID: Q9H173
  ENSP ID: ENSP00000378294

SEQ ID NO: 79260 - protein, 125 aa, Homo sapiens
  Payload ID: 15788
  Gene Symbol: SIL1
  Gene Name: SIL1 nucleotide exchange factor
  ENSP ID: ENSP00000421890
MQEMSDMSLTMAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLK

SEQ ID NO: 79261 - protein, 94 aa, Homo sapiens
  Payload ID: 15788
  Gene Symbol: SIL1
  Gene Name: SIL1 nucleotide exchange factor
  ENSP ID: ENSP00000423662
MAPQSLPSSRMAPLGMLLGLLMAACFTFCLSHQNLKEFALTNPEKSSTKETERKETKAEEELDAEVLEVFHPTHEWQALQPGQAVPAGSHVRLN

SEQ ID NO: 79262 - protein, 123 aa, Homo sapiens
  Payload ID: 15788
  Gene Symbol: SIL1
  Gene Name: SIL1 nucleotide exchange factor
  ENSP ID: ENSP00000424014
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINT

SEQ ID NO: 79263 - protein, 83 aa, Homo sapiens
  Payload ID: 15788
  Gene Symbol: SIL1
  Gene Name: SIL1 nucleotide exchange factor
  ENSP ID: ENSP00000425136
LKSALAKFKEGAEMESSKEDKMDNAQDLLSFGGLQVVINGLNSTEPLVKEYAAFVLGAAFSSNPKVQVEAIEGGALQKLLVIL

SEQ ID NO: 79264 - protein, 123 aa, Homo sapiens
  Payload ID: 15788
  Gene Symbol: SIL1
  Gene Name: SIL1 nucleotide exchange factor
  ENSP ID: ENSP00000426460
MQEMSDMSLTMAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNN

SEQ ID NO: 79265 - protein, 468 aa, Homo sapiens
  Payload ID: 15788
  Gene Symbol: SIL1
  Gene Name: SIL1 nucleotide exchange factor
  ENSP ID: ENSP00000426858
MNSGTSLTMAPQSLPSSRMAPLGMLLGLLMAACFTFCLSHQNLEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 79266 - protein, 163 aa, Homo sapiens
  Payload ID: 15788
  Gene Symbol: SIL1
  Gene Name: SIL1 nucleotide exchange factor
  ENSP ID: ENSP00000427371
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRP

SEQ ID NO: 79267 - protein, 1273 aa, Homo sapiens
  Payload ID: 15789
  Gene Symbol: SIN3A
  Gene Name: SIN3 transcription regulator family member A
  Uniprot ID: Q96ST3
  ENSP ID: ENSP00000353622
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQVYNDFLDIMKEFKSQSIDTPGVISRVSQLFKGHPDLIMGFNTFLPPGYKIEVQTNDMVNVTTPGQVHQIPTHGIQPQPQPPPQHPSQPSAQSAPAPAQPAPQPPPAKVSKPSQLQAHTPASQQTPPLPPYASPRSPPVQPHTPVTISLGTAPSLQNNQPVEFNHAINYVNKIKNRFQGQPDIYKAFLEILHTYQKEQRNAKEAGGNYTPALTEQEVYAQVARLFKNQEDLLSEFGQFLPDANSSVLLSKTTAEKVDSVRNDHGGTVKKPQLNNKPQRPSQNGCQIRRHPTGTTPPVKKKPKLLNLKDSSMADASKHGGGTESLFFDKVRKALRSAEAYENFLRCLVIFNQEVISRAELVQLVSPFLGKFPELFNWFKNFLGYKESVHLETYPKERATEGIAMEIDYASCKRLGSSYRALPKSYQQPKCTGRTPLCKEVLNDTWVSFPSWSEDSTFVSSKKTQYEEHIYRCEDERFELDVVLETNLATIRVLEAIQKKLSRLSAEEQAKFRLDNTLGGTSEVIHRKALQRIYADKAADIIDGLRKNPSIAVPIVLKRLKMKEEEWREAQRGFNKVWREQNEKYYLKSLDHQGINFKQNDTKVLRSKSLLNEIESIYDERQEQATEENAGVPVGPHLSLAYEDKQILEDAAALIIHHVKRQTGIQKEDKYKIKQIMHHFIPDLLFAQRGDLSDVEEEEEEEMDVDEATGAVKKHNGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSRSLLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKLNSYKMVYVIKSEDYMYRRTALLRAHQSHERVSKRLHQRFQAWVDKWTKEHVPREMAAETSKWLMGEGLEGLVPCTTTCDTETLHFVSINKYRVKYGTVFKAP

SEQ ID NO: 79268 - protein, 1273 aa, Homo sapiens; identical to SEQ ID NO: 79267
  Payload ID: 15789
  Gene Symbol: SIN3A
  Gene Name: SIN3 transcription regulator family member A
  Uniprot ID: Q96ST3
  ENSP ID: ENSP00000378402

SEQ ID NO: 79269 - protein, 1273 aa, Homo sapiens; identical to SEQ ID NO: 79267
  Payload ID: 15789
  Gene Symbol: SIN3A
  Gene Name: SIN3 transcription regulator family member A
  Uniprot ID: Q96ST3
  ENSP ID: ENSP00000378403

SEQ ID NO: 79270 - protein, 18 aa, Homo sapiens
  Payload ID: 15789
  Gene Symbol: SIN3A
  Gene Name: SIN3 transcription regulator family member A
  ENSP ID: ENSP00000454296
MKRRLDDQESPVYAAQQR

SEQ ID NO: 79271 - protein, 130 aa, Homo sapiens
  Payload ID: 15789
  Gene Symbol: SIN3A
  Gene Name: SIN3 transcription regulator family member A
  ENSP ID: ENSP00000454750
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYL

SEQ ID NO: 79272 - protein, 142 aa, Homo sapiens
  Payload ID: 15789
  Gene Symbol: SIN3A
  Gene Name: SIN3 transcription regulator family member A
  ENSP ID: ENSP00000455072
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQ

SEQ ID NO: 79273 - protein, 176 aa, Homo sapiens
  Payload ID: 15789
  Gene Symbol: SIN3A
  Gene Name: SIN3 transcription regulator family member A
  ENSP ID: ENSP00000455204
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQVYNDFLDIMKEFKSQSIDTPGVISRVSQLFKGHP

SEQ ID NO: 79274 - protein, 107 aa, Homo sapiens
  Payload ID: 15789
  Gene Symbol: SIN3A
  Gene Name: SIN3 transcription regulator family member A
  ENSP ID: ENSP00000455644
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAP

SEQ ID NO: 79275 - protein, 123 aa, Homo sapiens
  Payload ID: 15789
  Gene Symbol: SIN3A
  Gene Name: SIN3 transcription regulator family member A
  ENSP ID: ENSP00000455662
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKV

SEQ ID NO: 79276 - protein, 156 aa, Homo sapiens
  Payload ID: 15789
  Gene Symbol: SIN3A
  Gene Name: SIN3 transcription regulator family member A
  ENSP ID: ENSP00000455834
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVVFSSFSWVKKFIFSRKYWLQLVGCGGTTSNLRY

SEQ ID NO: 79277 - protein, 98 aa, Homo sapiens
  Payload ID: 15789
  Gene Symbol: SIN3A
  Gene Name: SIN3 transcription regulator family member A
  ENSP ID: ENSP00000456997
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQV

SEQ ID NO: 79278 - protein, 1130 aa, Homo sapiens
  Payload ID: 15790
  Gene Symbol: SIN3B
  Gene Name: SIN3 transcription regulator family member B
  Uniprot ID: O75182
  ENSP ID: ENSP00000248054
MAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKEVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 79279 - protein, 1162 aa, Homo sapiens
  Payload ID: 15790
  Gene Symbol: SIN3B
  Gene Name: SIN3 transcription regulator family member B
  Uniprot ID: O75182
  ENSP ID: ENSP00000369131
MAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKELDHWTLLQGSWTDDYCMSKFKNTCWIPGYSAGVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 79280 - protein, 720 aa, Homo sapiens
  Payload ID: 15790
  Gene Symbol: SIN3B
  Gene Name: SIN3 transcription regulator family member B
  ENSP ID: ENSP00000469740
MQRHSRHFLLVQVLNDTWVSFPSWSEDSTFVSSKKTPYEEQLHRCEDERFELDVVLETNLATIRVLESVQKKLSRMAPEDQEKFRLDDSLGGTSEVIQRRAIYRIYGDKAPEIIESLKKNPVTAVPVVLKRLKAKEEEWREAQQGFNKIWREQYEKAYLKSLDHQAVNFKQNDTKALRSKSLLNEIESVYDEHQEQHSEGRSAPSSEPHLIFVYEDRQILEDAAALISYYVKRQPAIQKEDQGTIHQLLHQFVPSLFFSQQLDLGASEESADEDRDSPQGQTTDPSERKKPAPGPHSSPPEEKGAFGDAPATEQPPLPPPAPHKPLDDVYSLFFANNNWYFFLRLHQTLCSRLLKIYRQAQKQLLEYRTEKEREKLLCEGRREKGSDPAMELRLKQPSEVELEEYYPAFLDMVRSLLEGSIDPTQYEDTLREMFTIHAYVGFTMDKLVQNIARQLHHLVSDDVCLKVVELYLNEKKRGAAGGNLSSRCVRAARETSYQWKAERCMADENCFKVMFLQRKGQVIMTIELLDTEEAQTEDPVEVQHLARYVEQYVGTEGASSSPTEGFLLKPVFLQRNLKKFRRRWQSEQARALRGEARSSWKRLVGVESACDVDCRFKLSTHKMVFIVNSEDYMYRRGTLCRAKQVQPLVLLRHHQHFEEWHSRWLEDNVTVEAASLVQDWLMGEEDEDMVPCKTLCETVHVHGLPVTRYRVQYSRRPASP

SEQ ID NO: 79281 - protein, 309 aa, Homo sapiens
  Payload ID: 15790
  Gene Symbol: SIN3B
  Gene Name: SIN3 transcription regulator family member B
  ENSP ID: ENSP00000472365
  MOD_RES (1)..(1): Any amino acid
XLHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLGKFPELFAQFKSFLGVKELSFAPPMSDRSGDGISREIDYASCKRIGSSYRALPKTYQQPKCSGRTAICKELDHWTLLQGSWTDDYCMSKFKNTCWIPGYSAGVSKLWPTGPGPLPVFVNKVLLSHRHNHSFTYCLWLLFSPQRQS

SEQ ID NO: 79282 - protein, 353 aa, Homo sapiens
  Payload ID: 15790
  Gene Symbol: SIN3B
  Gene Name: SIN3 transcription regulator family member B
  Uniprot ID: O75182
  ENSP ID: ENSP00000473039
MAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQKNEHDKTPEHSRKRSRPSLLRPVSAPAKKKMKLRGTKDLSIAAVGKYGTLQEFSFFDKVRRVLKSQEVYENFLRCIALFNQELVSGSELLQLVSPFLG

SEQ ID NO: 79283 - protein, 1056 aa, Homo sapiens
  Payload ID: 15791
  Gene Symbol: SAP130
  Gene Name: Sin3A-associated protein, 130kDa
  ENSP ID: ENSP00000259234
MSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALSRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSVVLADGATIVANPISNPFSAAPAATTVVQTHSQSASTNAPAQGSSPRPSILRKKPATDGMAVRKTLIPPQPPDVASPRVESSMRSTSGSPRPAGAKPKSEIHVSMATPVTVSMETVSNQNNDQPTIAVPPTAQQPPPTIPTMIAAASPPSQPAVALSTIPGAVPITPPITTIAAAPPPSVTVGGSLSSVLGPPVPEIKVKEEVEPMDIMRPVSAVPPLATNTVSPSLALLANNLSMPTSDLPPGASPRKKPRKQQHVISTEEGDMMETNSTDDEKSTAKSLLVKAEKRKSPPKEYIDEEGVRYVPVRPRPPITLLRHYRNPWKAAYHHFQRYSDVRVKEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 79284 - protein, 1048 aa, Homo sapiens
  Payload ID: 15791
  Gene Symbol: SAP130
  Gene Name: Sin3A-associated protein, 130kDa
  Uniprot ID: Q9H0E3
  ENSP ID: ENSP00000259235
MGPPRHPQAGEIEAGGAGGGRRLQVEMSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALSRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSAVVLADGATIVANPISNPFSAAPAATTVVQTHSQSASTNAPAQGSSPRPSILRKKPATDGAKPKSEIHVSMATPVTVSMETVSNQNNDQPTIAVPPTAQQPPPTIPTMIAAASPPSQPAVALSTIPGAVPITPPITTIAAAPPPSVTVGGSLSSVLGPPVPEIKVKEEVEPMDIMRPVSAVPPLATNTVSPSLALLANNLSMPTSDLPPGASPRKKPRKQQHVISTEEGDMMETNSTDDEKSTAKSLLVKAEKRKSPPKEYIDEEGVRYVPVRPRPPITLLRHYRNPWKAAYHHFQRYSDVRVKEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 79285 - protein, 1083 aa, Homo sapiens
  Payload ID: 15791
  Gene Symbol: SAP130
  Gene Name: Sin3A-associated protein, 130kDa
  Uniprot ID: Q9H0E3
  ENSP ID: ENSP00000350333
MGPPRHPQAGEIEAGGAGGGRRLQVEMSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALSRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSAVVLADGATIVANPISNPFSAAPAATTVVQTHSQSASTNAPAQGSSPRPSILRKKPATDGMAVRKTLIPPQPPDVASPRVESSMRSTSGSPRPAGAKPKSEIHVSMATPVTVSMETVSNQNNDQPTIAVPPTAQQPPPTIPTMIAAASPPSQPAVALSTIPGAVPITPPITTIAAAPPPSVTVGGSLSSVLGPPVPEIKVKEEVEPMDIMRPVSAVPPLATNTVSPSLALLANNLSMPTSDLPPGASPRKKPRKQQHVISTEEGDMMETNSTDDEKSTAKSLLVKAEKRKSPPKEYIDEEGVRYVPVRPRPPITLLRHYRNPWKAAYHHFQRYSDVRVKEEKKAMLQEIANQKGVSCRAQGWKVHLCAAQLLQLTNLEHDVYERLTNLQEGIIPKKKAATDDDLHRINELIQGNMQRCKLVMDQISEARDSMLKVLDHKDRVLKLLNKNGTVKKVSKLKRKEKV

SEQ ID NO: 79286 - protein, 262 aa, Homo sapiens
  Payload ID: 15791
  Gene Symbol: SAP130
  Gene Name: Sin3A-associated protein, 130kDa
  ENSP ID: ENSP00000411634
MSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPA

SEQ ID NO: 79287 - protein, 144 aa, Homo sapiens
  Payload ID: 15791
  Gene Symbol: SAP130
  Gene Name: Sin3A-associated protein, 130kDa
  ENSP ID: ENSP00000414593
MSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKVPGQVTVTMESSIPQASAIPVATISGQQ

SEQ ID NO: 79288 - protein, 172 aa, Homo sapiens
  Payload ID: 15792
  Gene Symbol: SAP18
  Gene Name: Sin3A-associated protein, 18kDa
  ENSP ID: ENSP00000371973
MLAAGVGGQGERLAGRRRKMAVESRVTQEEIKKEPEKPIDREKTCPLLLRVFTTNNGRHHRMDEFSRGNVPSSELQIYTWMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 79289 - protein, 143 aa, Homo sapiens
  Payload ID: 15792
  Gene Symbol: SAP18
  Gene Name: Sin3A-associated protein, 18kDa
  ENSP ID: ENSP00000391846
MSSGFAAGVFNFCPSVFSLPQTCPLLLRVFTTNNGRHHRMDEFSRGNVPSSELQIYTWMDATLKELTSLVKEVYPEARKKGTHFNFAIVFTDVKRPGYRVKEIGSTMSGRKGTDDSMTLQSQKFQIGDYLDIAITPPNRAPPP

SEQ ID NO: 79290 - protein, 78 aa, Homo sapiens
  Payload ID: 15792
  Gene Symbol: SAP18
  Gene Name: Sin3A-associated protein, 18kDa
  ENSP ID: ENSP00000475358
TCPLLLRVFTTNNGRHHRMDEFSRGNVPSSELQIYTWMDATLKELTSLVKEVYPEARKKGTHFNFAIVFTDVKRPGYR

SEQ ID NO: 79291 - protein, 59 aa, Homo sapiens
  Payload ID: 15792
  Gene Symbol: SAP18
  Gene Name: Sin3A-associated protein, 18kDa
  ENSP ID: ENSP00000475435
  MOD_RES (1)..(1): Any amino acid
XVESRVTQEEIKKEPEKPIDREKTCPLLLRVFTTNNGRHHRMDEFSRGNVPSSELQIYT

SEQ ID NO: 79292 - protein, 153 aa, Homo sapiens
  Payload ID: 15792
  Gene Symbol: SAP18
  Gene Name: Sin3A-associated protein, 18kDa
  Uniprot ID: O00422
  ENSP ID: ENSP00000475925
MAVESRVTQEEIKKEPEKPIDREKTCPLLLRVFTTNNGRHHRMDEFSRGNVPSSELQIYTWMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 79293 - protein, 172 aa, Homo sapiens; identical to SEQ ID NO: 79288
  Payload ID: 15792
  Gene Symbol: SAP18
  Gene Name: Sin3A-associated protein, 18kDa
  ENSP ID: ENSP00000481842

SEQ ID NO: 79294 - protein, 199 aa, Homo sapiens
  Payload ID: 15793
  Gene Symbol: SAP25
  Gene Name: Sin3A-associated protein, 25kDa
  Uniprot ID: Q8TEE9
  ENSP ID: ENSP00000442339
MTPLAPWDPKYEAKAGPRPVWGANCSSGASFSGRTLCHPSFWPLYEAASGRGLRPVAPATGHWNGQQAPPDAGFPVVCCEDVFLSDPLLPRGQRVPLYLSKAPQQMMGSLKLLPPPPIMSARVLPRPSPSRGPSTAWLSGPELIALTGLLQMSQGEPRPSSSAVGPPDHTSDPPSPCGSPSSSQGADLSLPQTPDTHCP

SEQ ID NO: 79295 - protein, 199 aa, Homo sapiens; identical to SEQ ID NO: 79294
  Payload ID: 15793
  Gene Symbol: SAP25
  Gene Name: Sin3A-associated protein, 25kDa
  Uniprot ID: Q8TEE9
  ENSP ID: ENSP00000481351

SEQ ID NO: 79296 - protein, 297 aa, Homo sapiens
  Payload ID: 15793
  Gene Symbol: SAP25
  Gene Name: Sin3A-associated protein, 25kDa
  ENSP ID: ENSP00000481773
MLPWSPPRWGAGPEEAPEGPGLPAGKDQGEPWSAGADAPRELGTPPWDSPQPPSRSPSWIWREQLLLPHHLPGPATEQPPGAPDPRSPQVAWEVAPSRMTPLAPWDPKYEAKAGPRPVWGANCSSGASFSGRTLCHPSFWPLYEAASGRGLRPVAPATGHWNGQQAPPDAGFPVVCCEDVFLSDPLLPRGQRVPLYLSKAPQQMMGSLKLLPPPPIMSARVLPRPSPSRGPSTAWLSGPELIALTGLLQMSQGEPRPSSSAVGPPDHTSDPPSPCGSPSSSQGADLSLPQTPDTHCP

SEQ ID NO: 79297 - protein, 220 aa, Homo sapiens
  Payload ID: 15794
  Gene Symbol: SAP30
  Gene Name: Sin3A-associated protein, 30kDa
  Uniprot ID: O75446
  ENSP ID: ENSP00000296504
MNGFTPDEMSRGGDAAAAVAAVVAAAAAAASAGNGTGAGTGAEVPGAGAVSAAGPPGAAGPGPGQLCCLREDGERCGRAAGNASFSKRIQKSISQKKVKIELDKSARHLYICDYHKNLIQSVRNRRKRKGSDDDGGDSPVQDIDTPEVDLYQLQVNTLRRYKRHFKLPTRPGLNKAQLVEIVGCHFRSIPVNEKDTLTYFIYSVKNDKNKSDLKVDSGVH

SEQ ID NO: 79298 - protein, 873 aa, Homo sapiens
  Payload ID: 15795
  Gene Symbol: SOBP
  Gene Name: sine oculis binding protein homolog
  Uniprot ID: A7XYQ1
  ENSP ID: ENSP00000318900
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKARDEDGHAENFPQQHYAKETPRLAFKNNCELLVCDWCKHIRHTKEYLDFGDGERRLQFCSAKCLNQYKMDIFYKETQANLPAGLCSTLHPPMENKAEGTGVQLLTPDSWNIPLTDARRKAPSPVATAGQSQGPGPSASTTVSPSDTANCSVTKIPTPVPKSIPISETPNIPPVSVQPPASIGPPLGVPPRSPPMVMTNRGPVPLPIFMEQQIMQQIRPPFIRGPPHHASNPNSPLSNPMLPGIGPPPGGPRNLGPTSSPMHRPMLSPHIHPPSTPTMPGNPPGLLPPPPPGAPLPSLPFPPVSMMPNGPMPVPQMMNFGLPSLAPLVPPPTLLVPYPVIVPLPVPIPIPIPIPHVSDSKPPNGFSSNGENFIPNAPGDSAAAGGKPSGHSLSPRDSKQGSSKSADSPPGCSGQALSLAPTPAEHGRSEVVDLTRRAGSPPGPPGAGGQLGFPGVLQGPQDGVIDLTVGHRARLHNVIHRALHAHVKAEREPSAAERRTCGGCRDGHCSPPAAGDPGPGAPAGPEAAAACNVIVNGTRGAAAEGAKSAEPPPEQPPPPPPPAPPKKLLSPEEPAVSELESVKENNCASNCHLDGEAAKKLMGEEALAGGDKSDPNLNNPADEDHAYALRMLPKTGCVIQPVPKPAEKAAMAPCIISSPMLSAGPEDLEPPLKRRCLRIRNQNK

SEQ ID NO: 79299 - protein, 149 aa, Homo sapiens
  Payload ID: 15795
  Gene Symbol: SOBP
  Gene Name: sine oculis binding protein homolog
  ENSP ID: ENSP00000478366
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPADEKTEAQKS

SEQ ID NO: 79300 - protein, 410 aa, Homo sapiens
  Payload ID: 15796
  Gene Symbol: SIGIRR
  Gene Name: single immunoglobulin and toll-interleukin 1 receptor (TIR) domain
  Uniprot ID: Q6IA17
  ENSP ID: ENSP00000333656
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVQYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 79301 - protein, 410 aa, Homo sapiens; identical to SEQ ID NO: 79300
  Payload ID: 15796
  Gene Symbol: SIGIRR
  Gene Name: single immunoglobulin and toll-interleukin 1 receptor (TIR) domain
  Uniprot ID: Q6IA17
  ENSP ID: ENSP00000380756

SEQ ID NO: 79302 - protein, 410 aa, Homo sapiens; identical to SEQ ID NO: 79300
  Payload ID: 15796
  Gene Symbol: SIGIRR
  Gene Name: single immunoglobulin and toll-interleukin 1 receptor (TIR) domain
  Uniprot ID: Q6IA17
  ENSP ID: ENSP00000403104

SEQ ID NO: 79303 - protein, 57 aa, Homo sapiens
  Payload ID: 15796
  Gene Symbol: SIGIRR
  Gene Name: single immunoglobulin and toll-interleukin 1 receptor (TIR) domain
  ENSP ID: ENSP00000431698
MRQASWCHQGWATGVCDRAPDFLSPSEDQVLRPALGSSVALNCTAWVVSGPHCSLPS

SEQ ID NO: 79304 - protein, 504 aa, Homo sapiens
  Payload ID: 15796
  Gene Symbol: SIGIRR
  Gene Name: single immunoglobulin and toll-interleukin 1 receptor (TIR) domain
  ENSP ID: ENSP00000433022
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVQYRPVEGDPQTQLQDDKDPMLILRGRVPEGRALDSEVDPDPEGDLGMPAQPHSPTGEAQHRAEWGQAQGTGPGGAPGVEDSSRHREPLHGLCPGGARPSVCLGTSWASQAITAGGEQGQPLAVGLGQGCGWPPQASRSPHPRCPGACLWRAISSTAHQWGLAGREPEQRSGRLGSRLAKLQCPHRLLLPGVQG

SEQ ID NO: 79305 - protein, 142 aa, Homo sapiens
  Payload ID: 15796
  Gene Symbol: SIGIRR
  Gene Name: single immunoglobulin and toll-interleukin 1 receptor (TIR) domain
  ENSP ID: ENSP00000433530
  MOD_RES (1)..(1): Any amino acid
XPLPTPHRGAFGRLPEPGLVQPQLPTPSSDFWKEVQLALPRKVQYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 79306 - protein, 143 aa, Homo sapiens
  Payload ID: 15796
  Gene Symbol: SIGIRR
  Gene Name: single immunoglobulin and toll-interleukin 1 receptor (TIR) domain
  ENSP ID: ENSP00000434030
MPGVCDRAPDFLSPSEDQVLRPALGSSVALNCTAWVVSGPHCSLPSVQWLKDGLPLGIGGHYSLHEYSWPYKPRGCGAGLPPGPAGPAAGRPALCQVPSQRAALVPGRVWGGGDKRDCPEDRKFVNFILKPQLERRRGYKLFL

SEQ ID NO: 79307 - protein, 130 aa, Homo sapiens
  Payload ID: 15796
  Gene Symbol: SIGIRR
  Gene Name: single immunoglobulin and toll-interleukin 1 receptor (TIR) domain
  ENSP ID: ENSP00000434164
PDPEGDLGMPAQPHSPTGEAQHRAEWGQAQGTGPGGAPGVEDSSRHREPLHGLCPGGARPSVCLGTSWASQAITAGGVRGPVFGEPSAPPHTSGVSLGESRSSEVDVSDLGSRNYSARTDFYCLVSKDDM

SEQ ID NO: 79308 - protein, 189 aa, Homo sapiens
  Payload ID: 15796
  Gene Symbol: SIGIRR
  Gene Name: single immunoglobulin and toll-interleukin 1 receptor (TIR) domain
  ENSP ID: ENSP00000435135
MGPSPAPSRTSASPPSLFRELALQATWLRCWPPSWSCWPCCWPPCSMSSAVSTCCSDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSV

SEQ ID NO: 79309 - protein, 368 aa, Homo sapiens
  Payload ID: 15797
  Gene Symbol: SSBP3
  Gene Name: single stranded DNA binding protein 3
  Uniprot ID: Q9BWW4
  ENSP ID: ENSP00000350067
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 79310 - protein, 361 aa, Homo sapiens
  Payload ID: 15797
  Gene Symbol: SSBP3
  Gene Name: single stranded DNA binding protein 3
  Uniprot ID: Q9BWW4
  ENSP ID: ENSP00000360370
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 79311 - protein, 388 aa, Homo sapiens
  Payload ID: 15797
  Gene Symbol: SSBP3
  Gene Name: single stranded DNA binding protein 3
  Uniprot ID: Q9BWW4
  ENSP ID: ENSP00000360371
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 79312 - protein, 156 aa, Homo sapiens
  Payload ID: 15797
  Gene Symbol: SSBP3
  Gene Name: single stranded DNA binding protein 3
  ENSP ID: ENSP00000405880
PPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNVSLLSNNLHIRHHNKS

SEQ ID NO: 79313 - protein, 278 aa, Homo sapiens
  Payload ID: 15797
  Gene Symbol: SSBP3
  Gene Name: single stranded DNA binding protein 3
  ENSP ID: ENSP00000414361
MPGGPIPPGFFQGPPGSQPSPHAQPPPHNPSSMMGPHSQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 79314 - protein, 101 aa, Homo sapiens
  Payload ID: 15797
  Gene Symbol: SSBP3
  Gene Name: single stranded DNA binding protein 3
  ENSP ID: ENSP00000431654
MPGGPIPPGFFQPFMSPRYAGGPRPPIRMGNQPPGGVPGTQPLLPNSMDPTRQQGHPNMGGSMQRMNPPRGMGPMGPGPQNYGSGMRPPPNSLGPAMPGIN

SEQ ID NO: 79315 - protein, 361 aa, Homo sapiens
  Payload ID: 15797
  Gene Symbol: SSBP3
  Gene Name: single stranded DNA binding protein 3
  ENSP ID: ENSP00000479674
AVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQPFMSPRYAGGPRPPIRMGNQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSVSPLLRDAE

SEQ ID NO: 79316 - protein, 363 aa, Homo sapiens
  Payload ID: 15798
  Gene Symbol: SSBP4
  Gene Name: single stranded DNA binding protein 4
  Uniprot ID: Q9BWG4
  ENSP ID: ENSP00000252807
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 79317 - protein, 385 aa, Homo sapiens
  Payload ID: 15798
  Gene Symbol: SSBP4
  Gene Name: single stranded DNA binding protein 4
  Uniprot ID: Q9BWG4
  ENSP ID: ENSP00000270061
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQGPPGSQPSPHNPNAPMMGPHGQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 79318 - protein, 53 aa, Homo sapiens
  Payload ID: 15798
  Gene Symbol: SSBP4
  Gene Name: single stranded DNA binding protein 4
  ENSP ID: ENSP00000472975
MYAKGGKGSAVPSDSQAREKYCLSLSLPSRTWPPGQGPGVCTAQKALHGCWRN

SEQ ID NO: 79319 - protein, 206 aa, Homo sapiens
  Payload ID: 15798
  Gene Symbol: SSBP4
  Gene Name: single stranded DNA binding protein 4
  ENSP ID: ENSP00000475352
  MOD_RES (1)..(1): Any amino acid
XPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESVSDCVDSPPAAASGRRGWRAGPGGAAGGPEQDRDRGGPVLARDDHERVMGRQPRASLRA

SEQ ID NO: 79320 - protein, 234 aa, Homo sapiens
  Payload ID: 15798
  Gene Symbol: SSBP4
  Gene Name: single stranded DNA binding protein 4
  ENSP ID: ENSP00000475538
MGLSAVVPAAGYTFAVWSAMLSVAANVCGWVYNNVGGRLHLRLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMN

SEQ ID NO: 79321 - protein, 56 aa, Homo sapiens
  Payload ID: 15798
  Gene Symbol: SSBP4
  Gene Name: single stranded DNA binding protein 4
  ENSP ID: ENSP00000475668
MGSMAPGDTMAAGSMAAGFFQPFMSPRFPGGPRPTLRMPSQPPAGLPGSQPLLPGA

SEQ ID NO: 79322 - protein, 117 aa, Homo sapiens
  Payload ID: 15798
  Gene Symbol: SSBP4
  Gene Name: single stranded DNA binding protein 4
  ENSP ID: ENSP00000476084
MGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRG

SEQ ID NO: 79323 - protein, 54 aa, Homo sapiens
  Payload ID: 15798
  Gene Symbol: SSBP4
  Gene Name: single stranded DNA binding protein 4
  ENSP ID: ENSP00000476092
MYAKGGKGSAVPSDSQAREKLALYVYEYLLHIGAQKSAQTFLSERLLGPVLRGA

SEQ ID NO: 79324 - protein, 71 aa, Homo sapiens
  Payload ID: 15798
  Gene Symbol: SSBP4
  Gene Name: single stranded DNA binding protein 4
  ENSP ID: ENSP00000476567
MAPARLSRCPCLSVSVGSGDMDGLPKSSPGAVAGLSNAPGTPRDDGEMAAAGTFLHPFPSESYSPGMTMSV

SEQ ID NO: 79325 - protein, 53 aa, Homo sapiens; identical to SEQ ID NO: 79318
  Payload ID: 15798
  Gene Symbol: SSBP4
  Gene Name: single stranded DNA binding protein 4
  ENSP ID: ENSP00000486132

SEQ ID NO: 79326 - protein, 766 aa, Homo sapiens
  Payload ID: 15799
  Gene Symbol: SIM1
  Gene Name: single-minded family bHLH transcription factor 1
  Uniprot ID: P81133
  ENSP ID: ENSP00000262901
MKEKSKNAARTRREKENSEFYELAKLLPLPSAITSQLDKASIIRLTTSYLKMRVVFPEGLGEAWGHSSRTSPLDNVGRELGSHLLQTLDGFIFVVAPDGKIMYISETASVHLGLSQVELTGNSIYEYIHPADHDEMTAVLTAHQPYHSHFVQEYEIERSFFLRMKCVLAKRNAGLTCGGYKVIHCSGYLKIRQYSLDMSPFDGCYQNVGLVAVGHSLPPSAVTEIKLHSNMFMFRASLDMKLIFLDSRVAELTGYEPQDLIEKTLYHHVHGCDTFHLRCAHHLLLVKGQVTTKYYRFLAKHGGWVWVQSYATIVHNSRSSRPHCIVSVNYVLTDTEYKGLQLSLDQISASKPAFSYTSSSTPTMTDNRKGAKSRLSSSKSKSRTSPYPQYSGFHTERSESDHDSQWGGSPLTDTASPQLLDPADRPGSQHDASCAYRQFSDRSSLCYGFALDHSRLVEERHFHTQACEGGRCEAGRYFLGTPQAGREPWWGSRAALPLTKASPESREAYENSMPHIASVHRIHGRGHWDEDSVVSSPDPGSASESGDRYRTEQYQSSPHEPSKIETLIRATQQMIKEEENRLQLRKAPSDQLASINGAGKKHSLCFANYQQPPPTGEVCHGSALANTSPCDHIQQREGKMLSPHENDYDNSPTALSRISSPNSDRISKSSLILAKDYLHSDISPHQTAGDHPTVSPNCFGSHRQYFDKHAYTLTGYALEHLYDSETIRNYSLGCNGSHFDVTSHLRMQPDPAQGHKGTSVIITNGS

SEQ ID NO: 79327 - protein, 766 aa, Homo sapiens; identical to SEQ ID NO: 79326
  Payload ID: 15799
  Gene Symbol: SIM1
  Gene Name: single-minded family bHLH transcription factor 1
  Uniprot ID: P81133
  ENSP ID: ENSP00000358210

SEQ ID NO: 79328 - protein, 667 aa, Homo sapiens
  Payload ID: 15800
  Gene Symbol: SIM2
  Gene Name: single-minded family bHLH transcription factor 2
  Uniprot ID: Q14190
  ENSP ID: ENSP00000290399
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPASAAAPPELQPHSESSDLLYTPSYSLPFSYHYGHFPLDSHVFSSKKPMLPAKFGQPQGSPCEVARFFLSTLPASGECQWHYANPLVPSSSSPAKNPPEPPANTARHSLVPSYEAPAAAVRRFGEDTAPPSFPSCGHYREEPALGPAKAARQAARDGARLALARAAPECCAPPTPEAPGAPAQLPFVLLNYHRVLARRGPLGGAAPAASGLACAPGGPEAATGALRLRHPSPAATSPPGAPLPHYLGASVIITNGR

SEQ ID NO: 79329 - protein, 480 aa, Homo sapiens
  Payload ID: 15800
  Gene Symbol: SIM2
  Gene Name: single-minded family bHLH transcription factor 2
  ENSP ID: ENSP00000392003
  MOD_RES (1)..(1): Any amino acid
XWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPASAAAPPELQPHSESSDLLYTPSYSLPFSYHYGHFPLDSHVFSSKKPMLPAKFGQPQGSPCEVARFFLSTLPASGECQWHYANPLVPSSSSPAKNPPEPPANTARHSLVPSYEGKQMSSAEIPPAPQDAD

SEQ ID NO: 79330 - protein, 73 aa, Homo sapiens
  Payload ID: 15800
  Gene Symbol: SIM2
  Gene Name: single-minded family bHLH transcription factor 2
  ENSP ID: ENSP00000476273
DGKIMYISETASVHLGLSQVELTGNSIYEYIHPSDHDEMTAVLTAHQPLHHHLLQGIPSRGKKKNRLKARRHS

SEQ ID NO: 79331 - protein, 107 aa, Homo sapiens
  Payload ID: 15801
  Gene Symbol: SMDT1
  Gene Name: single-pass membrane protein with aspartate-rich tail 1
  Uniprot ID: Q9H4I9
  ENSP ID: ENSP00000327467
MASGAARWLVLAPVRSGALRSGPSLRKDGDVSAAWSGSGRSLVPSRSVIVTRSGAILPKPVKMSFGLLRVFSIVIPFLYVGTLISKNFAALLEEHDIFVPEDDDDDD

SEQ ID NO: 79332 - protein, 57 aa, Homo sapiens
  Payload ID: 15801
  Gene Symbol: SMDT1
  Gene Name: single-pass membrane protein with aspartate-rich tail 1
  ENSP ID: ENSP00000402623
MASGAARWLVLAPVRSGALRSGPSLRKDGDVSAAWSGSGRSLVPSRCPSAFSVCSPL

SEQ ID NO: 79333 - protein, 107 aa, Homo sapiens; identical to SEQ ID NO: 79331
  Payload ID: 15801
  Gene Symbol: SMDT1
  Gene Name: single-pass membrane protein with aspartate-rich tail 1
  Uniprot ID: Q9H4I9
  ENSP ID: ENSP00000459368

SEQ ID NO: 79334 - protein, 107 aa, Homo sapiens; identical to SEQ ID NO: 79331
  Payload ID: 15801
  Gene Symbol: SMDT1
  Gene Name: single-pass membrane protein with aspartate-rich tail 1
  Uniprot ID: Q9H4I9
  ENSP ID: ENSP00000475471

SEQ ID NO: 79335 - protein, 57 aa, Homo sapiens; identical to SEQ ID NO: 79332
  Payload ID: 15801
  Gene Symbol: SMDT1
  Gene Name: single-pass membrane protein with aspartate-rich tail 1
  ENSP ID: ENSP00000477174

SEQ ID NO: 79336 - protein, 107 aa, Homo sapiens; identical to SEQ ID NO: 79331
  Payload ID: 15801
  Gene Symbol: SMDT1
  Gene Name: single-pass membrane protein with aspartate-rich tail 1
  Uniprot ID: Q9H4I9
  ENSP ID: ENSP00000485029

SEQ ID NO: 79337 - protein, 57 aa, Homo sapiens; identical to SEQ ID NO: 79332
  Payload ID: 15801
  Gene Symbol: SMDT1
  Gene Name: single-pass membrane protein with aspartate-rich tail 1
  ENSP ID: ENSP00000485728

SEQ ID NO: 79338 - protein, 57 aa, Homo sapiens; identical to SEQ ID NO: 79332
  Payload ID: 15801
  Gene Symbol: SMDT1
  Gene Name: single-pass membrane protein with aspartate-rich tail 1
  ENSP ID: ENSP00000487546

SEQ ID NO: 79339 - protein, 214 aa, Homo sapiens
  Payload ID: 15802
  Gene Symbol: SMCO1
  Gene Name: single-pass membrane protein with coiled-coil domains 1
  Uniprot ID: Q147U7
  ENSP ID: ENSP00000380671
MNNETTTLISLKEAMKRVDHKLQALETQFKELDFTKDNLMQKFEHHSKALASQAAQDEMWTAVRALQLTSMELNILYSYVIEVLICLHTRVLEKLPDLVRGLPTLASVLRRKVKNKRVRVVWESILEECGLQEGDITALCTFFIARGNKAEHYTAKVRQMYIRDVTFLITNMVKNQALQDSLLRAVQVIEKGKAVRTPEKQKSSLEELIPSVKN

SEQ ID NO: 79340 - protein, 36 aa, Homo sapiens
  Payload ID: 15802
  Gene Symbol: SMCO1
  Gene Name: single-pass membrane protein with coiled-coil domains 1
  ENSP ID: ENSP00000413102
MNNETTTLISLKEAMKRLLRAIGREQAWVCYSGKME

SEQ ID NO: 79341 - protein, 293 aa, Homo sapiens
  Payload ID: 15803
  Gene Symbol: SMCO2
  Gene Name: single-pass membrane protein with coiled-coil domains 2
  ENSP ID: ENSP00000298876
MALTPTNLNNKMSLQMKMDCQEQQLTKKNNGFFQKLNVTEGAMQDLLKEIIKVDHILDRSDDEDDISSENPQTDFLHKGMLELEAEHDQDLSKQDKQETDVDEDPQASTSLQFSKKNLLELLLKDMLTLKGQIEKLEDRGLDLDQGTSTEVNTCNEVYELKKKVIERLEDLCKNVELLSAKLRMYQMEAEDTDSHSSEEIDTEEMEALLPQAPASFLVQKSPPRNTAWKRALRIFIMFDVLTVTGLLCYILFFGATFLFERVLLRMLGCRTTWDLREMREPFLNLEVEALLPS

SEQ ID NO: 79342 - protein, 343 aa, Homo sapiens
  Payload ID: 15803
  Gene Symbol: SMCO2
  Gene Name: single-pass membrane protein with coiled-coil domains 2
  Uniprot ID: A6NFE2
  ENSP ID: ENSP00000387617
MALTPTNLNNKMSLQMKMDCQEQQLTKKNNGFFQKLNVTEGAMQDLLKEIIKVDHILDRSDDEDDISSENPQTDFLHKGMLELEAEHDQDLSKQDKQETDVDEDPQASTSLQFSKKNLLELCLKGMFLKLNYWNTKIGLQVKELGADYIDGTEKIDNIIKKINVTENTVKSLLKDMLTLKGQIEKLEDRGLDLDQGTSTEVNTCNEVYELKKKVIERLEDLCKNVELLSAKLRMYQMEAEDTDSHSSEEIDTEEMEALLPQAPASFLVQKSPPRNTAWKRALRIFIMFDVLTVTGLLCYILFFGATFLFERVLLRMLGCRTTWDLREMREPFLNLEVEALLPS

SEQ ID NO: 79343 - protein, 343 aa, Homo sapiens; identical to SEQ ID NO: 79342
  Payload ID: 15803
  Gene Symbol: SMCO2
  Gene Name: single-pass membrane protein with coiled-coil domains 2
  Uniprot ID: A6NFE2
  ENSP ID: ENSP00000441688

SEQ ID NO: 79344 - protein, 225 aa, Homo sapiens
  Payload ID: 15804
  Gene Symbol: SMCO3
  Gene Name: single-pass membrane protein with coiled-coil domains 3
  Uniprot ID: A2RU48
  ENSP ID: ENSP00000381895
MAQSDFLYPENPKRREEVNRLHQQLLDCLSDSFDVTNKLTEVLNMHLGCRLASIEMKRDGTIKENCDLIIQAIMKIQKELQKVDEALKDKLEPTLYRKLQDIKEKETDKIAIVQKVISVILGEATSAASAVAVKLVGSNVTTGIINKLVTVLAQIGASLLGSIGVAVLGLGIDMIVRAILGAVEKTQLQAAIKSYEKHLVEFKSASEKYNHAITEVINTVKHQMK

SEQ ID NO: 79345 - protein, 59 aa, Homo sapiens
  Payload ID: 15805
  Gene Symbol: SMCO4
  Gene Name: single-pass membrane protein with coiled-coil domains 4
  Uniprot ID: Q9NRQ5
  ENSP ID: ENSP00000298966
MRQLKGKPKKETSKDKKERKQAMQEARQQITTVVLPTLAVVVLLIVVFVYVATRPTITE

SEQ ID NO: 79346 - protein, 59 aa, Homo sapiens; identical to SEQ ID NO: 79345
  Payload ID: 15805
  Gene Symbol: SMCO4
  Gene Name: single-pass membrane protein with coiled-coil domains 4
  Uniprot ID: Q9NRQ5
  ENSP ID: ENSP00000431781

SEQ ID NO: 79347 - protein, 52 aa, Homo sapiens
  Payload ID: 15805
  Gene Symbol: SMCO4
  Gene Name: single-pass membrane protein with coiled-coil domains 4
  ENSP ID: ENSP00000432581
MRQLKGKPKKETSKDKKERKQAMQEARQQITTVVLPTLAVVVLLIVVFVYVA

SEQ ID NO: 79348 - protein, 59 aa, Homo sapiens; identical to SEQ ID NO: 79345
  Payload ID: 15805
  Gene Symbol: SMCO4
  Gene Name: single-pass membrane protein with coiled-coil domains 4
  Uniprot ID: Q9NRQ5
  ENSP ID: ENSP00000433555

SEQ ID NO: 79349 - protein, 47 aa, Homo sapiens
  Payload ID: 15805
  Gene Symbol: SMCO4
  Gene Name: single-pass membrane protein with coiled-coil domains 4
  ENSP ID: ENSP00000435827
MRQLKGKPKKETSKDKKERKQAMQEARQQITTVVLPTLAVVVLLIVV

SEQ ID NO: 79350 - protein, 59 aa, Homo sapiens; identical to SEQ ID NO: 79345
  Payload ID: 15805
  Gene Symbol: SMCO4
  Gene Name: single-pass membrane protein with coiled-coil domains 4
  Uniprot ID: Q9NRQ5
  ENSP ID: ENSP00000479594

SEQ ID NO: 79351 - protein, 148 aa, Homo sapiens
  Payload ID: 15806
  Gene Symbol: SSBP1
  Gene Name: single-stranded DNA binding protein 1, mitochondrial
  Uniprot ID: Q04837
  ENSP ID: ENSP00000265304
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADNIIFLSDQTKEKE

SEQ ID NO: 79352 - protein, 135 aa, Homo sapiens
  Payload ID: 15806
  Gene Symbol: SSBP1
  Gene Name: single-stranded DNA binding protein 1, mitochondrial
  ENSP ID: ENSP00000418068
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIAD

SEQ ID NO: 79353 - protein, 28 aa, Homo sapiens
  Payload ID: 15806
  Gene Symbol: SSBP1
  Gene Name: single-stranded DNA binding protein 1, mitochondrial
  ENSP ID: ENSP00000418181
MFRRPVLQVLRQFVRHESETTTSLVLER

SEQ ID NO: 79354 - protein, 148 aa, Homo sapiens; identical to SEQ ID NO: 79351
  Payload ID: 15806
  Gene Symbol: SSBP1
  Gene Name: single-stranded DNA binding protein 1, mitochondrial
  Uniprot ID: Q04837
  ENSP ID: ENSP00000419388

SEQ ID NO: 79355 - protein, 148 aa, Homo sapiens; identical to SEQ ID NO: 79351
  Payload ID: 15806
  Gene Symbol: SSBP1
  Gene Name: single-stranded DNA binding protein 1, mitochondrial
  Uniprot ID: Q04837
  ENSP ID: ENSP00000419541

SEQ ID NO: 79356 - protein, 121 aa, Homo sapiens
  Payload ID: 15806
  Gene Symbol: SSBP1
  Gene Name: single-stranded DNA binding protein 1, mitochondrial
  ENSP ID: ENSP00000419579
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMD

SEQ ID NO: 79357 - protein, 148 aa, Homo sapiens; identical to SEQ ID NO: 79351
  Payload ID: 15806
  Gene Symbol: SSBP1
  Gene Name: single-stranded DNA binding protein 1, mitochondrial
  Uniprot ID: Q04837
  ENSP ID: ENSP00000419665

SEQ ID NO: 79358 - protein, 148 aa, Homo sapiens; identical to SEQ ID NO: 79351
  Payload ID: 15806
  Gene Symbol: SSBP1
  Gene Name: single-stranded DNA binding protein 1, mitochondrial
  Uniprot ID: Q04837
  ENSP ID: ENSP00000420485

SEQ ID NO: 79359 - protein, 28 aa, Homo sapiens
  Payload ID: 15806
  Gene Symbol: SSBP1
  Gene Name: single-stranded DNA binding protein 1, mitochondrial
  ENSP ID: ENSP00000458403
MFRRPVLQVLRQFVRHESETTTSLVLER

SEQ ID NO: 79360 - protein, 134 aa, Homo sapiens
  Payload ID: 15806
  Gene Symbol: SSBP1
  Gene Name: single-stranded DNA binding protein 1, mitochondrial
  Uniprot ID: Q04837
  ENSP ID: ENSP00000458815
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIA

SEQ ID NO: 79361 - protein, 134 aa, Homo sapiens; identical to SEQ ID NO: 79360
  Payload ID: 15806
  Gene Symbol: SSBP1
  Gene Name: single-stranded DNA binding protein 1, mitochondrial
  Uniprot ID: Q04837
  ENSP ID: ENSP00000459208

SEQ ID NO: 79362 - protein, 134 aa, Homo sapiens; identical to SEQ ID NO: 79360
  Payload ID: 15806
  Gene Symbol: SSBP1
  Gene Name: single-stranded DNA binding protein 1, mitochondrial
  Uniprot ID: Q04837
  ENSP ID: ENSP00000459367

SEQ ID NO: 79363 - protein, 134 aa, Homo sapiens; identical to SEQ ID NO: 79360
  Payload ID: 15806
  Gene Symbol: SSBP1
  Gene Name: single-stranded DNA binding protein 1, mitochondrial
  Uniprot ID: Q04837
  ENSP ID: ENSP00000460028

SEQ ID NO: 79364 - protein, 134 aa, Homo sapiens; identical to SEQ ID NO: 79360
  Payload ID: 15806
  Gene Symbol: SSBP1
  Gene Name: single-stranded DNA binding protein 1, mitochondrial
  ENSP ID: ENSP00000460161

SEQ ID NO: 79365 - protein, 121 aa, Homo sapiens; identical to SEQ ID NO: 79356
  Payload ID: 15806
  Gene Symbol: SSBP1
  Gene Name: single-stranded DNA binding protein 1, mitochondrial
  ENSP ID: ENSP00000461315

SEQ ID NO: 79366 - protein, 134 aa, Homo sapiens; identical to SEQ ID NO: 79360
  Payload ID: 15806
  Gene Symbol: SSBP1
  Gene Name: single-stranded DNA binding protein 1, mitochondrial
  Uniprot ID: Q04837
  ENSP ID: ENSP00000461884

SEQ ID NO: 79367 - protein, 148 aa, Homo sapiens; identical to SEQ ID NO: 79351
  Payload ID: 15806
  Gene Symbol: SSBP1
  Gene Name: single-stranded DNA binding protein 1, mitochondrial
  Uniprot ID: Q04837
  ENSP ID: ENSP00000480488

SEQ ID NO: 79368 - protein, 361 aa, Homo sapiens
  Payload ID: 15807
  Gene Symbol: SSBP2
  Gene Name: single-stranded DNA binding protein 2
  Uniprot ID: P81877
  ENSP ID: ENSP00000322977
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 79369 - protein, 208 aa, Homo sapiens
  Payload ID: 15807
  Gene Symbol: SSBP2
  Gene Name: single-stranded DNA binding protein 2
  ENSP ID: ENSP00000422756
MLVIPSALMYSFVLYWRLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMN

SEQ ID NO: 79370 - protein, 298 aa, Homo sapiens
  Payload ID: 15807
  Gene Symbol: SSBP2
  Gene Name: single-stranded DNA binding protein 2
  Uniprot ID: P81877
  ENSP ID: ENSP00000422961
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKYSPSMTMSV

SEQ ID NO: 79371 - protein, 341 aa, Homo sapiens
  Payload ID: 15807
  Gene Symbol: SSBP2
  Gene Name: single-stranded DNA binding protein 2
  Uniprot ID: P81877
  ENSP ID: ENSP00000423969
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 79372 - protein, 264 aa, Homo sapiens
  Payload ID: 15807
  Gene Symbol: SSBP2
  Gene Name: single-stranded DNA binding protein 2
  ENSP ID: ENSP00000424561
SAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGKAFQFDNSPNNMSLSNQPGTPRDDGEMGGNFLNPFQSESYSPSMTMSV

SEQ ID NO: 79373 - protein, 339 aa, Homo sapiens
  Payload ID: 15807
  Gene Symbol: SSBP2
  Gene Name: single-stranded DNA binding protein 2
  Uniprot ID: P81877
  ENSP ID: ENSP00000424657
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYPFMSPRYPGGPRPPLRIPNQALGGVPGSQPLLPSGMDPTRQQGHPNMGGPMQRMTPPRGMVPLGPQSDPWLSLQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 79374 - protein, 275 aa, Homo sapiens
  Payload ID: 15807
  Gene Symbol: SSBP2
  Gene Name: single-stranded DNA binding protein 2
  ENSP ID: ENSP00000425146
SAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQSDPWLSLQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 79375 - protein, 331 aa, Homo sapiens
  Payload ID: 15807
  Gene Symbol: SSBP2
  Gene Name: single-stranded DNA binding protein 2
  Uniprot ID: P81877
  ENSP ID: ENSP00000426183
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 79376 - protein, 369 aa, Homo sapiens
  Payload ID: 15807
  Gene Symbol: SSBP2
  Gene Name: single-stranded DNA binding protein 2
  ENSP ID: ENSP00000483921
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQSDPWLSLQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 79377 - protein, 314 aa, Homo sapiens [sequence omitted]

SEQ ID NO: 79378 - protein, 177 aa, Homo sapiens
  Payload ID: 15808
  Gene Symbol: SMUG1
  Gene Name: single-strand-selective monofunctional uracil-DNA glycosylase 1
  Uniprot ID: Q53HV7
  ENSP ID: ENSP00000243112
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEGPRQSMGHEIKSELLMGGCSWIRGKIQCDRVQVRRPGFSSQL

SEQ ID NO: 79379 - protein, 270 aa, Homo sapiens
  Payload ID: 15808
  Gene Symbol: SMUG1
  Gene Name: single-strand-selective monofunctional uracil-DNA glycosylase 1
  Uniprot ID: Q53HV7
  ENSP ID: ENSP00000338606
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAPSGRNLTPAELPAKQREQLLGICDAALCRQVQLLGVRLVVGVGRLAEQRARRALAGLMPEVQVEGLLHPSPRNPQANKGWEAVAKERLNELGLLPLLLK

SEQ ID NO: 79380 - protein, 270 aa, Homo sapiens; identical to SEQ ID NO: 79379
  Payload ID: 15808
  Gene Symbol: SMUG1
  Gene Name: single-strand-selective monofunctional uracil-DNA glycosylase 1
  Uniprot ID: Q53HV7
  ENSP ID: ENSP00000384828

SEQ ID NO: 79381 - protein, 177 aa, Homo sapiens; identical to SEQ ID NO: 79378
  Payload ID: 15808
  Gene Symbol: SMUG1
  Gene Name: single-strand-selective monofunctional uracil-DNA glycosylase 1
  Uniprot ID: Q53HV7
  ENSP ID: ENSP00000421139

SEQ ID NO: 79382 - protein, 177 aa, Homo sapiens; identical to SEQ ID NO: 79378
  Payload ID: 15808
  Gene Symbol: SMUG1
  Gene Name: single-strand-selective monofunctional uracil-DNA glycosylase 1
  Uniprot ID: Q53HV7
  ENSP ID: ENSP00000421206

SEQ ID NO: 79383 - protein, 95 aa, Homo sapiens
  Payload ID: 15808
  Gene Symbol: SMUG1
  Gene Name: single-strand-selective monofunctional uracil-DNA glycosylase 1
  ENSP ID: ENSP00000421790
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTG

SEQ ID NO: 79384 - protein, 126 aa, Homo sapiens
  Payload ID: 15808
  Gene Symbol: SMUG1
  Gene Name: single-strand-selective monofunctional uracil-DNA glycosylase 1
  ENSP ID: ENSP00000421894
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVKGLASPVGGVGGSRWMLGWVCCGEGACAWL

SEQ ID NO: 79385 - protein, 172 aa, Homo sapiens
  Payload ID: 15808
  Gene Symbol: SMUG1
  Gene Name: single-strand-selective monofunctional uracil-DNA glycosylase 1
  ENSP ID: ENSP00000423083
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAP

SEQ ID NO: 79386 - protein, 108 aa, Homo sapiens
  Payload ID: 15808
  Gene Symbol: SMUG1
  Gene Name: single-strand-selective monofunctional uracil-DNA glycosylase 1
  ENSP ID: ENSP00000423457
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWL

SEQ ID NO: 79387 - protein, 177 aa, Homo sapiens; identical to SEQ ID NO: 79378
  Payload ID: 15808
  Gene Symbol: SMUG1
  Gene Name: single-strand-selective monofunctional uracil-DNA glycosylase 1
  Uniprot ID: Q53HV7
  ENSP ID: ENSP00000423629

SEQ ID NO: 79388 - protein, 270 aa, Homo sapiens; identical to SEQ ID NO: 79379
  Payload ID: 15808
  Gene Symbol: SMUG1
  Gene Name: single-strand-selective monofunctional uracil-DNA glycosylase 1
  Uniprot ID: Q53HV7
  ENSP ID: ENSP00000424191

SEQ ID NO: 79389 - protein, 82 aa, Homo sapiens
  Payload ID: 15808
  Gene Symbol: SMUG1
  Gene Name: single-strand-selective monofunctional uracil-DNA glycosylase 1
  ENSP ID: ENSP00000425426
MPQAFLLGSIHEPAGALMEPQPCPGSLAESFLEEELRLNAELSQLQFSEPVGIIYNPVEYAWEPHRNYVTRYCQGPKEVLFL

SEQ ID NO: 79390 - protein, 159 aa, Homo sapiens
  Payload ID: 15808
  Gene Symbol: SMUG1
  Gene Name: single-strand-selective monofunctional uracil-DNA glycosylase 1
  ENSP ID: ENSP00000425974
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEANKGWEAVAKERLNELGLLPLLLK

SEQ ID NO: 79391 - protein, 143 aa, Homo sapiens
  Payload ID: 15808
  Gene Symbol: SMUG1
  Gene Name: single-strand-selective monofunctional uracil-DNA glycosylase 1
  ENSP ID: ENSP00000426440
  MOD_RES (1)..(1): Any amino acid
XAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEKILAAVLRTD

SEQ ID NO: 79392 - protein, 90 aa, Homo sapiens
  Payload ID: 15808
  Gene Symbol: SMUG1
  Gene Name: single-strand-selective monofunctional uracil-DNA glycosylase 1
  ENSP ID: ENSP00000427547
MPQAFLLGSIHEPAGALMEPQPCPGSLAESFLEEELRLNAELSQLQFSEPVGIIYNPVEYAWEPHRNYVTRYCQGPKEVLFLGMNPGPFG

SEQ ID NO: 79393 - protein, 161 aa, Homo sapiens
  Payload ID: 15808
  Gene Symbol: SMUG1
  Gene Name: single-strand-selective monofunctional uracil-DNA glycosylase 1
  ENSP ID: ENSP00000489489
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEEDIGQLFPLLPWCPREVKNFNWSMRH

SEQ ID NO: 79394 - protein, 747 aa, Homo sapiens
  Payload ID: 15809
  Gene Symbol: SIRT1
  Gene Name: sirtuin 1
  Uniprot ID: Q96EB6
  ENSP ID: ENSP00000212015
MADEAALALQPGGSPSAAGADREAASSPAGEPLRKRPRRDGPGLERSPGEPGGAAPEREVPAAARGCPGAAAAALWREAEAEAAAAGGEQEAQATAAAGEGDNGPGLQGPSREPPLADNLYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 79395 - protein, 444 aa, Homo sapiens
  Payload ID: 15809
  Gene Symbol: SIRT1
  Gene Name: sirtuin 1
  ENSP ID: ENSP00000384063
MCLCSGRKTILEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 79396 - protein, 444 aa, Homo sapiens; identical to SEQ ID NO: 79395
  Payload ID: 15809
  Gene Symbol: SIRT1
  Gene Name: sirtuin 1
  ENSP ID: ENSP00000384508

SEQ ID NO: 79397 - protein, 452 aa, Homo sapiens
  Payload ID: 15809
  Gene Symbol: SIRT1
  Gene Name: sirtuin 1
  ENSP ID: ENSP00000409208
MFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 79398 - protein, 389 aa, Homo sapiens
  Payload ID: 15810
  Gene Symbol: SIRT2
  Gene Name: sirtuin 2
  Uniprot ID: Q8IXJ6
  ENSP ID: ENSP00000249396
MAEPDPSHPLETQAGKVQEAQDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 79399 - protein, 234 aa, Homo sapiens
  Payload ID: 15810
  Gene Symbol: SIRT2
  Gene Name: sirtuin 2
  ENSP ID: ENSP00000351809
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQGRGLAG

SEQ ID NO: 79400 - protein, 352 aa, Homo sapiens
  Payload ID: 15810
  Gene Symbol: SIRT2
  Gene Name: sirtuin 2
  Uniprot ID: Q8IXJ6
  ENSP ID: ENSP00000375931
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 79401 - protein, 169 aa, Homo sapiens
  Payload ID: 15810
  Gene Symbol: SIRT2
  Gene Name: sirtuin 2
  ENSP ID: ENSP00000385146
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPL

SEQ ID NO: 79402 - protein, 78 aa, Homo sapiens
  Payload ID: 15810
  Gene Symbol: SIRT2
  Gene Name: sirtuin 2
  ENSP ID: ENSP00000397022
MDFLRNLFSQTLSLGSQKERLLDELTLEGVARYMQSERCRRVICLVGAGISTSAGIPDFRSPSTGLYDNLEKYHLPYP

SEQ ID NO: 79403 - protein, 111 aa, Homo sapiens
  Payload ID: 15810
  Gene Symbol: SIRT2
  Gene Name: sirtuin 2
  ENSP ID: ENSP00000400338
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKFPHL

SEQ ID NO: 79404 - protein, 130 aa, Homo sapiens
  Payload ID: 15810
  Gene Symbol: SIRT2
  Gene Name: sirtuin 2
  ENSP ID: ENSP00000401203
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQ

SEQ ID NO: 79405 - protein, 237 aa, Homo sapiens
  Payload ID: 15810
  Gene Symbol: SIRT2
  Gene Name: sirtuin 2
  ENSP ID: ENSP00000404309
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLIS

SEQ ID NO: 79406 - protein, 39 aa, Homo sapiens
  Payload ID: 15810
  Gene Symbol: SIRT2
  Gene Name: sirtuin 2
  ENSP ID: ENSP00000407272
MDFLRNLFSQTLSLGSQKERLLDELTLEGVARYMQSERC

SEQ ID NO: 79407 - protein, 73 aa, Homo sapiens
  Payload ID: 15810
  Gene Symbol: SIRT2
  Gene Name: sirtuin 2
  ENSP ID: ENSP00000408023
MDFLRNLFSQTLSLGSQKERLLDELTLEGVARYMQSERCRRVICLVGAGISTSAGIPDFRSPSTGLYDNLEKY

SEQ ID NO: 79408 - protein, 52 aa, Homo sapiens
  Payload ID: 15810
  Gene Symbol: SIRT2
  Gene Name: sirtuin 2
  ENSP ID: ENSP00000409690
MDFLRNLFSQTLSLGSQKERLLDELTLEGVARYMQSERSATVSLLRQPGLLP

SEQ ID NO: 79409 - protein, 96 aa, Homo sapiens
  Payload ID: 15810
  Gene Symbol: SIRT2
  Gene Name: sirtuin 2
  ENSP ID: ENSP00000411393
MAEPDPSHPLETQAGKVQEAQATFLPQPFPQTWYHPLSSLPNPTSRAWPLHPTPSRTQIQTLREEPLVEKQTWTSCGTYSPRRSAWAARRSVCWTS

SEQ ID NO: 79410 - protein, 389 aa, Homo sapiens
  Payload ID: 15810
  Gene Symbol: SIRT2
  Gene Name: sirtuin 2
  ENSP ID: ENSP00000481932
MSDEAEDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQGGGGPQPQHFSFPQEVPATCQGRGQDNREGETPVTAASPRRDAELLRDS

SEQ ID NO: 79411 - protein, 352 aa, Homo sapiens; identical to SEQ ID NO: 79400
  Payload ID: 15810
  Gene Symbol: SIRT2
  Gene Name: Sirtuin 2
  ENSP ID: ENSP00000488940

SEQ ID NO: 79412 - protein, 234 aa, Homo sapiens; identical to SEQ ID NO: 79399
  Payload ID: 15810
  Gene Symbol: SIRT2
  Gene Name: Sirtuin 2
  ENSP ID: ENSP00000488998

SEQ ID NO: 79413 - protein, 389 aa, Homo sapiens; identical to SEQ ID NO: 79410
  Payload ID: 15810
  Gene Symbol: SIRT2
  Gene Name: Sirtuin 2
  ENSP ID: ENSP00000489020

SEQ ID NO: 79414 - protein, 111 aa, Homo sapiens; identical to SEQ ID NO: 79403
  Payload ID: 15810
  Gene Symbol: SIRT2
  Gene Name: Sirtuin 2
  ENSP ID: ENSP00000489036

SEQ ID NO: 79415 - protein, 130 aa, Homo sapiens; identical to SEQ ID NO: 79404
  Payload ID: 15810
  Gene Symbol: SIRT2
  Gene Name: Sirtuin 2
  ENSP ID: ENSP00000489066

SEQ ID NO: 79416 - protein, 73 aa, Homo sapiens; identical to SEQ ID NO: 79407
  Payload ID: 15810
  Gene Symbol: SIRT2
  Gene Name: Sirtuin 2
  ENSP ID: ENSP00000489070

SEQ ID NO: 79417 - protein, 52 aa, Homo sapiens; identical to SEQ ID NO: 79408
  Payload ID: 15810
  Gene Symbol: SIRT2
  Gene Name: Sirtuin 2
  ENSP ID: ENSP00000489238

SEQ ID NO: 79418 - protein, 39 aa, Homo sapiens; identical to SEQ ID NO: 79406
  Payload ID: 15810
  Gene Symbol: SIRT2
  Gene Name: Sirtuin 2
  ENSP ID: ENSP00000489332

SEQ ID NO: 79419 - protein, 78 aa, Homo sapiens; identical to SEQ ID NO: 79402
  Payload ID: 15810
  Gene Symbol: SIRT2
  Gene Name: Sirtuin 2
  ENSP ID: ENSP00000489360

SEQ ID NO: 79420 - protein, 237 aa, Homo sapiens; identical to SEQ ID NO: 79405
  Payload ID: 15810
  Gene Symbol: SIRT2
  Gene Name: Sirtuin 2
  ENSP ID: ENSP00000489426

SEQ ID NO: 79421 - protein, 169 aa, Homo sapiens; identical to SEQ ID NO: 79401
  Payload ID: 15810
  Gene Symbol: SIRT2
  Gene Name: Sirtuin 2
  ENSP ID: ENSP00000489481

SEQ ID NO: 79422 - protein, 96 aa, Homo sapiens; identical to SEQ ID NO: 79409
  Payload ID: 15810
  Gene Symbol: SIRT2
  Gene Name: Sirtuin 2
  ENSP ID: ENSP00000489495

SEQ ID NO: 79423 - protein, 389 aa, Homo sapiens; identical to SEQ ID NO: 79398
  Payload ID: 15810
  Gene Symbol: SIRT2
  Gene Name: Sirtuin 2
  ENSP ID: ENSP00000489602

SEQ ID NO: 79424 - protein, 399 aa, Homo sapiens
  Payload ID: 15811
  Gene Symbol: SIRT3
  Gene Name: sirtuin 3
  Uniprot ID: Q9NTG7
  ENSP ID: ENSP00000372191
MAFWGWRAAAALRLWGRVVERVEAGGGVGPFQACGCRLVLGGRDDVSAGLRGSHGARGEPLDPARPLQRPPRPEVPRAFRRQPRAAAPSFFFSSIKGGRRSISFSVGASSVVGSGGSSDKGKLSLQDVAELIRARACQRVVVMVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 79425 - protein, 93 aa, Homo sapiens
  Payload ID: 15811
  Gene Symbol: SIRT3
  Gene Name: sirtuin 3
  ENSP ID: ENSP00000432857
MVGAGISTPSGIPDFRSPGSGLYSNLQQYDLPYPEAIFELPFFFHNPKPFFTLAKELYPGNYKPNVTHYFLRLLHDKGLLLRLYTQNIDGLER

SEQ ID NO: 79426 - protein, 353 aa, Homo sapiens
  Payload ID: 15811
  Gene Symbol: SIRT3
  Gene Name: sirtuin 3
  ENSP ID: ENSP00000432937
MAFWGWRAAAALRLWGRVVERVEAGGGVGPFQACGCRLVLGGRDDVSAGLRGSHGARGEPLDPARPLQRPPRPEVPRAFRRQPRAAAPSFFFSRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKVQTAEEDHPRGCPSHCSRLDGPDK

SEQ ID NO: 79427 - protein, 345 aa, Homo sapiens
  Payload ID: 15811
  Gene Symbol: SIRT3
  Gene Name: sirtuin 3
  ENSP ID: ENSP00000433077
MAFWGWRAAAALRLWGRVVERVEAGGGVGPFQACGCRLVLGGRDDVSAGLRGSHGARGEPLDPARPLQRPPRPEVPRAFRRQPRAAAPSFFFSSIKGGRRSISFSVGASSVVGSGGSSDKGKLSLQDVAELIRARACQRVVVMVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRVEPFASLTEAVRSSVPRLLINRDLVGPLAWHPRSRDVAQLGDVVHGVESLVELLGWTEEMRDLVQRETGKLDGPDK

SEQ ID NO: 79428 - protein, 23 aa, Homo sapiens
  Payload ID: 15811
  Gene Symbol: SIRT3
  Gene Name: sirtuin 3
  ENSP ID: ENSP00000433132
MVGAGISTPSGIPDFRSPGSGLY

SEQ ID NO: 79429 - protein, 46 aa, Homo sapiens
  Payload ID: 15811
  Gene Symbol: SIRT3
  Gene Name: sirtuin 3
  ENSP ID: ENSP00000433899
MAFWGWRAAAALRLWGRVVERVEAGGGVGPFQACGCRLVLGGRDDY

SEQ ID NO: 79430 - protein, 134 aa, Homo sapiens
  Payload ID: 15811
  Gene Symbol: SIRT3
  Gene Name: sirtuin 3
  ENSP ID: ENSP00000434747
MAFWGWRAAAALRLWGRVVERVEAGGGVGPFQACGCRLVLGGRDDADVMADRVPRCPVCTGVVKPDIVFFGEPLPQRFLLHVVDFPMADLLLILGTSLEVCQQACAGRRLEGRGREGYRSHLMGPSRAGATLGR

SEQ ID NO: 79431 - protein, 46 aa, Homo sapiens; identical to SEQ ID NO: 79429
  Payload ID: 15811
  Gene Symbol: SIRT3
  Gene Name: sirtuin 3
  ENSP ID: ENSP00000435014

SEQ ID NO: 79432 - protein, 318 aa, Homo sapiens
  Payload ID: 15811
  Gene Symbol: SIRT3
  Gene Name: sirtuin 3
  ENSP ID: ENSP00000435464
MAFWGWRAAAALRLWGRVVERVEAGGGVGPFQACGCRLVLGGRDDDVAELIRARACQRVVVMVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 79433 - protein, 95 aa, Homo sapiens
  Payload ID: 15811
  Gene Symbol: SIRT3
  Gene Name: sirtuin 3
  ENSP ID: ENSP00000435505
MAFWGWRAAAALRLWGRVVERVEAGGGVGPFQACGCRLVLGGRDDVSAGLRGSHGARGEPLDPARPLQRPPRPEVPRAFRRQPRAAAPSFFFSRM

SEQ ID NO: 79434 - protein, 18 aa, Homo sapiens
  Payload ID: 15811
  Gene Symbol: SIRT3
  Gene Name: sirtuin 3
  ENSP ID: ENSP00000436085
MVGAGISTPSGIPDFRSP

SEQ ID NO: 79435 - protein, 46 aa, Homo sapiens; identical to SEQ ID NO: 79429
  Payload ID: 15811
  Gene Symbol: SIRT3
  Gene Name: sirtuin 3
  ENSP ID: ENSP00000437179

SEQ ID NO: 79436 - protein, 257 aa, Homo sapiens
  Payload ID: 15811
  Gene Symbol: SIRT3
  Gene Name: sirtuin 3
  Uniprot ID: Q9NTG7
  ENSP ID: ENSP00000437216
MVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 79437 - protein, 314 aa, Homo sapiens
  Payload ID: 15812
  Gene Symbol: SIRT4
  Gene Name: sirtuin 4
  Uniprot ID: Q9Y6E7
  ENSP ID: ENSP00000202967
MKMSFALTFRSAKGRWIANPSQPCSKASIGLFVPASPPLDPEKVKELQRFITLSKRLLVMTGAGISTESGIPDYRSEKVGLYARTDRRPIQHGDFVRSAPIRQRYWARNFVGWPQFSSHQPNPAHWALSTWEKLGKLYWLVTQNVDALHTKAGSRRLTELHGCMDRVLCLDCGEQTPRGVLQERFQVLNPTWSAEAHGLAPDGDVFLSEEQVRSFQVPTCVQCGGHLKPDVVFFGDTVNPDKVDFVHKRVKEADSLLVVGSSLQVYSGYRFILTAWEKKLPIAILNIGPTRSDDLACLKLNSRCGELLPLIDPC

SEQ ID NO: 79438 - protein, 106 aa, Homo sapiens
  Payload ID: 15812
  Gene Symbol: SIRT4
  Gene Name: sirtuin 4
  ENSP ID: ENSP00000444838
MTGAGISTESGIPDYRSEKVGLYARTDRRPIQHGDFVRSAPIRQRYWARNFVGWPQFSSHQPNPAHWALSTWEKLGKLYWLVTQNVDALHTKAGSRRLTELHGCMD

SEQ ID NO: 79439 - protein, 292 aa, Homo sapiens
  Payload ID: 15813
  Gene Symbol: SIRT5
  Gene Name: sirtuin 5
  Uniprot ID: Q9NXA8
  ENSP ID: ENSP00000352830
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVS

SEQ ID NO: 79440 - protein, 79 aa, Homo sapiens
  Payload ID: 15813
  Gene Symbol: SIRT5
  Gene Name: sirtuin 5
  ENSP ID: ENSP00000368552
MRPLQIVPSRLISQLYCGLKPPASTRNQICLKMARPSSRPGDSPGLCPQPVPGVGVLPLPAGGHGEQGAQRRAPRHSRV

SEQ ID NO: 79441 - protein, 299 aa, Homo sapiens
  Payload ID: 15813
  Gene Symbol: SIRT5
  Gene Name: sirtuin 5
  Uniprot ID: Q9NXA8
  ENSP ID: ENSP00000368564
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFSHLISISSLIIIKN

SEQ ID NO: 79442 - protein, 202 aa, Homo sapiens
  Payload ID: 15813
  Gene Symbol: SIRT5
  Gene Name: sirtuin 5
  Uniprot ID: Q9NXA8
  ENSP ID: ENSP00000380509
MGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVS

SEQ ID NO: 79443 - protein, 41 aa, Homo sapiens
  Payload ID: 15813
  Gene Symbol: SIRT5
  Gene Name: sirtuin 5
  ENSP ID: ENSP00000476211
MRPLQIVPSRLISQLYCGLKPPASTRNQICLKMARPSSTQG

SEQ ID NO: 79444 - protein, 310 aa, Homo sapiens
  Payload ID: 15813
  Gene Symbol: SIRT5
  Gene Name: sirtuin 5
  Uniprot ID: Q9NXA8
  ENSP ID: ENSP00000476228
MRPLQIVPSRLISQLYCGLKPPASTRNQICLKMARPSSSMADFRKFFAKAKHIVIISGAGVSAESGVPTFRGAGGYWRKWQAQDLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGAPEPGTQDASIPVEKLPRCEEAGCGGLLRPHVVWFGENLDPAILEEVDRELAHCDLCLVVGTSSVVYPAAMFAPQVAARGVPVAEFNTETTPATNRFRFHFQGPCGTTLPEALACHENETVS

SEQ ID NO: 79445 - protein, 328 aa, Homo sapiens
  Payload ID: 15814
  Gene Symbol: SIRT6
  Gene Name: sirtuin 6
  Uniprot ID: Q8N6T7
  ENSP ID: ENSP00000305310
MSVNYAAGLSPYADKGKCGLPEIFDPPEELERKVWELARLVWQSSSVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 79446 - protein, 355 aa, Homo sapiens
  Payload ID: 15814
  Gene Symbol: SIRT6
  Gene Name: sirtuin 6
  Uniprot ID: Q8N6T7
  ENSP ID: ENSP00000337332
MSVNYAAGLSPYADKGKCGLPEIFDPPEELERKVWELARLVWQSSSVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 79447 - protein, 187 aa, Homo sapiens
  Payload ID: 15814
  Gene Symbol: SIRT6
  Gene Name: sirtuin 6
  ENSP ID: ENSP00000469001
MSVNYAAGLSPYADKGKCGLPEIFDPPEELERKVWELARLVWQSSSVVFHTGAGISTASGIPDFRDKLAELHGNMFVEECAKCKTQYVRDTVVGTMGLKATGRLCTVAKARGLRACRGELRDTILDWEDSLPDRDLALADEASRSGPAGTCRWLPSAGEAAWSSSTCSPPSTTAMLTSASMATLTRS

SEQ ID NO: 79448 - protein, 275 aa, Homo sapiens
  Payload ID: 15814
  Gene Symbol: SIRT6
  Gene Name: sirtuin 6
  ENSP ID: ENSP00000470215
DKGKCGLPEIFDPPEELERKVWELARLVWQSSSVVFHTGAGISTASGIPDFRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVK

SEQ ID NO: 79449 - protein, 43 aa, Homo sapiens
  Payload ID: 15814
  Gene Symbol: SIRT6
  Gene Name: sirtuin 6
  ENSP ID: ENSP00000471123
MSVNYAAGLSPYADKGKCGLPEGSPRSLDHGGARSGPQVRHHL

SEQ ID NO: 79450 - protein, 186 aa, Homo sapiens
  Payload ID: 15814
  Gene Symbol: SIRT6
  Gene Name: sirtuin 6
  ENSP ID: ENSP00000471837
VNYAAGLSPYADKGKCGLPEIFDPPEELERKVWELARLVWQSSSVVFHTGAGISTASGIPDFRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHVGV

SEQ ID NO: 79451 - protein, 176 aa, Homo sapiens
  Payload ID: 15814
  Gene Symbol: SIRT6
  Gene Name: sirtuin 6
  ENSP ID: ENSP00000472023
MEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRSGPAGTCRWLPSAGEAAWSSSTCSPPSTTAMLTSASMATLTRS

SEQ ID NO: 79452 - protein, 43 aa, Homo sapiens; identical to SEQ ID NO: 79449
  Payload ID: 15814
  Gene Symbol: SIRT6
  Gene Name: sirtuin 6
  ENSP ID: ENSP00000473085

SEQ ID NO: 79453 - protein, 400 aa, Homo sapiens
  Payload ID: 15815
  Gene Symbol: SIRT7
  Gene Name: sirtuin 7
  Uniprot ID: Q9NRC8
  ENSP ID: ENSP00000329466
MAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 79454 - protein, 116 aa, Homo sapiens
  Payload ID: 15815
  Gene Symbol: SIRT7
  Gene Name: sirtuin 7
  ENSP ID: ENSP00000459524
MAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTVERE

SEQ ID NO: 79455 - protein, 150 aa, Homo sapiens
  Payload ID: 15815
  Gene Symbol: SIRT7
  Gene Name: sirtuin 7
  ENSP ID: ENSP00000461044
MSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQ

SEQ ID NO: 79456 - protein, 175 aa, Homo sapiens
  Payload ID: 15816
  Gene Symbol: SIVA1
  Gene Name: SIVA1, apoptosis-inducing factor
  Uniprot ID: O15304
  ENSP ID: ENSP00000329213
MPKRSCPFADVAPLQLKVRVSQRELSRGVCAERYSQEVFEKTKRLLFLGAQAYLDHVWDEGCAVVHLPESPKPGPTGAPRAARGQMLIGPDGRLIRSLGQASEADPSGVASIACSSCVRAVDGKAVCGQCERALCGQCVRTCWGCGSVACTLCGLVDCSDMYEKVLCTSCAMFET

SEQ ID NO: 79457 - protein, 110 aa, Homo sapiens
  Payload ID: 15816
  Gene Symbol: SIVA1
  Gene Name: SIVA1, apoptosis-inducing factor
  Uniprot ID: O15304
  ENSP ID: ENSP00000329447
MPKRSCPFADVAPLQLKVRVSQRELSRGVCAERYSQEVFDPSGVASIACSSCVRAVDGKAVCGQCERALCGQCVRTCWGCGSVACTLCGLVDCSDMYEKVLCTSCAMFET

SEQ ID NO: 79458 - protein, 169 aa, Homo sapiens
  Payload ID: 15816
  Gene Symbol: SIVA1
  Gene Name: SIVA1, apoptosis-inducing factor
  ENSP ID: ENSP00000451427
MPKRSCPFADVAPLQLKVRVSQRELSRGVCAERYSQEVFEKTKRLLFLGAQAYLDHVWDEGCAVVHLPESPKPGPTGAPRAARGQMLIGPDGRLIRSLGQASEADPSGVASIACSSCVRAVDGKAVCGQCERALCGQCVRTCWGCGSVACTLCGLVEPALCWKEHDVGM

SEQ ID NO: 79459 - protein, 169 aa, Homo sapiens
  Payload ID: 15816
  Gene Symbol: SIVA1
  Gene Name: SIVA1, apoptosis-inducing factor
  ENSP ID: ENSP00000451570
MPKRSCPFADVAPLQLKVRVSQRELSRGVCAERYSQEVFEKTKRLLFLGAQAYLDHVWDEGCAVVHLPESPKPGPTGAPRAARGQMLIGPDGRLIRSLGQASEADPSGVASIACSSCVRAVDGKAVCGQCERALCGQCVRTCWGCGSVACTLCGLVEGYSPGGWEWTVW

SEQ ID NO: 79460 - protein, 90 aa, Homo sapiens
  Payload ID: 15816
  Gene Symbol: SIVA1
  Gene Name: SIVA1, apoptosis-inducing factor
  ENSP ID: ENSP00000451823
MLIGPDGRLIRSLGQASEADPSGVASIACSSCVRAVDGKAVCGQCERALCGQCVRTCWGCGSVACTLCGLVDCSDMYEKVLCTSCAMFET

SEQ ID NO: 79461 - protein, 157 aa, Homo sapiens
  Payload ID: 15816
  Gene Symbol: SIVA1
  Gene Name: SIVA1, apoptosis-inducing factor
  ENSP ID: ENSP00000485991
MPKRSCPFADVAPLQLKVRVSQRELSRGVCAERYSQEVFEKTKRLLFLGAQAYLDHVWDEGCAVVHLPESPKPGPTGAPRAARGQMLIGPDGRLIRSLGQASEADPSGVASIACSSCVRAVDGKAVCGQCERALCGQCVRTCWGCGSVACTLCGLVE

SEQ ID NO: 79462 - protein, 284 aa, Homo sapiens
  Payload ID: 15817
  Gene Symbol: SIX1
  Gene Name: SIX homeobox 1
  Uniprot ID: Q15475
  ENSP ID: ENSP00000247182
MSMLPSFGFTQEQVACVCEVLQQGGNLERLGRFLWSLPACDHLHKNESVLKAKAVVAFHRGNFRELYKILESHQFSPHNHPKLQQLWLKAHYVEAEKLRGRPLGAVGKYRVRRKFPLPRTIWDGEETSYCFKEKSRGVLREWYAHNPYPSPREKRELAEATGLTTTQVSNWFKNRRQRDRAAEAKERENTENNNSSSNKQNQLSPLEGGKPLMSSSEEEFSPPQSPDQNSVLLLQGNMGHARSSNYSLPGLTASQPSHGLQTHQHQLQDSLLGPLTSSLVDLGS

SEQ ID NO: 79463 - protein, 111 aa, Homo sapiens
  Payload ID: 15817
  Gene Symbol: SIX1
  Gene Name: SIX homeobox 1
  ENSP ID: ENSP00000452700
MSMNPERPFKAEDKENTENNNSSSNKQNQLSPLEGGKPLMSSSEEEFSPPQSPDQNSVLLLQGNMGHARSSNYSLPGLTASQPSHGLQTHQHQLQDSLLGPLTSSLVDLGS

SEQ ID NO: 79464 - protein, 291 aa, Homo sapiens
  Payload ID: 15818
  Gene Symbol: SIX2
  Gene Name: SIX homeobox 2
  Uniprot ID: Q9NPC8
  ENSP ID: ENSP00000304502
MSMLPTFGFTQEQVACVCEVLQQGGNIERLGRFLWSLPACEHLHKNESVLKAKAVVAFHRGNFRELYKILESHQFSPHNHAKLQQLWLKAHYIEAEKLRGRPLGAVGKYRVRRKFPLPRSIWDGEETSYCFKEKSRSVLREWYAHNPYPSPREKRELAEATGLTTTQVSNWFKNRRQRDRAAEAKERENNENSNSNSHNPLNGSGKSVLGSSEDEKTPSGTPDHSSSSPALLLSPPPPGLPSLHSLGHPPGPSAVPVPVPGGGGADPLQHHHGLQDSILNPMSANLVDLGS

SEQ ID NO: 79465 - protein, 332 aa, Homo sapiens
  Payload ID: 15819
  Gene Symbol: SIX3
  Gene Name: SIX homeobox 3
  Uniprot ID: O95343
  ENSP ID: ENSP00000260653
MVFRSPLDLYSSHFLLPNFADSHHRSILLASSGGGNGAGGGGGAGGGSGGGNGAGGGGAGGAGGGGGGGSRAPPEELSMFQLPTLNFSPEQVASVCETLEETGDIERLGRFLWSLPVAPGACEAINKHESILRARAVVAFHTGNFRDLYHILENHKFTKESHGKLQAMWLEAHYQEAEKLRGRPLGPVDKYRVRKKFPLPRTIWDGEQKTHCFKERTRSLLREWYLQDPYPNPSKKRELAQATGLTPTQVGNWFKNRRQRDRAAAAKNRLQHQAIGPSGMRSLAEPGCPTHGSAESPSTAASPTTSVSSLTERADTGTSILSVTSSDSECDV

SEQ ID NO: 79466 - protein, 781 aa, Homo sapiens
  Payload ID: 15820
  Gene Symbol: SIX4
  Gene Name: SIX homeobox 4
  Uniprot ID: Q9UIU6
  ENSP ID: ENSP00000216513
MSSSSPTGQIASAADIKQENGMESASEGQEAHREVAGGAAVGLSPPAPAPFPLEPGDAATAAARVSGEEGAVAAAAAGAAADQVQLHSELLGRHHHAAAAAAQTPLAFSPDHVACVCEALQQGGNLDRLARFLWSLPQSDLLRGNESLLKARALVAFHQGIYPELYSILESHSFESANHPLLQQLWYKARYTEAERARGRPLGAVDKYRLRRKFPLPRTIWDGEETVYCFKEKSRNALKELYKQNRYPSPAEKRHLAKITGLSLTQVSNWFKNRRQRDRNPSETQSKSESDGNPSTEDESSKGHEDLSPHPLSSSSDGITNLSLSSHMEPVYMQQIGNAKISLSSSGVLLNGSLVPASTSPVFLNGNSFIQGPSGVILNGLNVGNTQAVALNPPKMSSNIVSNGISMTDILGSTSQDVKEFKVLQSSANSATTTSYSPSVPVSFPGLIPSTEVKREGIQTVASQDGGSVVTFTTPVQINQYGIVQIPNSGANSQFLNGSIGFSPLQLPPVSVAASQGNISVSSSTSDGSTFTSESTTVQQGKVFLSSLAPSAVVYTVPNTGQTIGSVKQEGLERSLVFSQLMPVNQNAQVNANLSSENISGSGLHPLASSLVNVSPTHNFSLSPSTLLNPTELNRDIADSQPMSAPVASKSTVTSVSNTNYATLQNCSLITGQDLLSVPMTQAALGEIVPTAEDQVGHPSPAVHQDFVQEHRLVLQSVANMKENFLSNSESKATSSLMMLDSKSKYVLDGMVDTVCEDLETDKKELAKLQTVQLDEDMQDL

SEQ ID NO: 79467 - protein, 494 aa, Homo sapiens
  Payload ID: 15820
  Gene Symbol: SIX4
  Gene Name: SIX homeobox 4
  ENSP ID: ENSP00000450761
MIASAADIKQENGMESASEGQEAHREVAGGAAVGLSPPAPAPFPLEPGDAATAAARVSGEEGAVAAAAAGAAADQVQLHSELLGRHHHAAAAAAQTPLAFSPDHVACVCEALQQGGNLDRLARFLWSLPQSDLLRGNESLLKARALVAFHQGIYPELYSILESHSFESANHPLLQQLWYKARYTEAERARGRPLGAVDKYRLRRKFPLPRTIWDGEETVYCFKEKSRNALKELYKQNRYPSPAEKRHLAKITGLSLTQVSNWFKNRRQRDRNPSETQSKSESDGNPSTEDESSKGHEDLSPHPLSSSSDGITNLSLSSHMEPVYMQQIGNAKISLSSSGVLLNGSLVPASTSPVFLNGNSFIQGPSGVILNGLNVGNTQAVALNPPKMSSNIVSNGISMTDILGSTSQDVKEFKVLQSSANSATTTSYSPSVPVSFPGLIPSTEVKREGIQTVASQDGGSVVTFTTPVQINQYGIVQIPNSGANSQFLNGSIGF

SEQ ID NO: 79468 - protein, 739 aa, Homo sapiens
  Payload ID: 15821
  Gene Symbol: SIX5
  Gene Name: SIX homeobox 5
  Uniprot ID: Q8N196
  ENSP ID: ENSP00000316842
MATLPAEPSAGPAAGGEAVAAAAATEEEEEEARQLLQTLQAAEGEAAAAAGAGAGAAAAGAEGPGSPGVPGSPPEAASEPPTGLRFSPEQVACVCEALLQAGHAGRLSRFLGALPPAERLRGSDPVLRARALVAFQRGEYAELYRLLESRPFPAAHHAFLQDLYLRARYHEAERARGRALGAVDKYRLRKKFPLPKTIWDGEETVYCFKERSRAALKACYRGNRYPTPDEKRRLATLTGLSLTQVSNWFKNRRQRDRTGAGGGAPCKSESDGNPTTEDESSRSPEDLERGAAPVSAEAAAQGSIFLAGTGPPAPCPASSSILVNGSFLAASGSPAVLLNGGPVIINGLALGEASSLGPLLLTGGGGAPPPQPSPQGASETKTSLVLDPQTGEVRLEEAQSEAPETKGAQVAAPGPALGEEVLGPLAQVVPGPPTAATFPLPPGPVPAVAAPQVVPLSPPPGYPTGLSPTSPLLNLPQVVPTSQVVTLPQAVGPLQLLAAGPGSPVKVAAAAGPANVHLINSGVGVTALQLPSATAPGNFLLANPVSGSPIVTGVALQQGKIILTATFPTSMLVSQVLPPAPGLALPLKPETAISVPEGGLPVAPSPALPEAHALGTLSAQQPPPAAATTSSTSLPFSPDSPGLLPNFPAPPPEGLMLSPAAVPVWSAGLELSAGTEGLLEAEKGLGTQAPHTVLRLPDPDPEGLLLGATAGGEVDEGLEAEAKVLTQLQSVPVEEPLEL

SEQ ID NO: 79469 - protein, 69 aa, Homo sapiens
  Payload ID: 15821
  Gene Symbol: SIX5
  Gene Name: SIX homeobox 5
  ENSP ID: ENSP00000453189
MATLPAEPSAGPAAGGEAVAAAAATEEEEEEARQLLQTLQAAEGQQLVQEPATARPDRGRRRRALQERV

SEQ ID NO: 79470 - protein, 255 aa, Homo sapiens
  Payload ID: 15821
  Gene Symbol: SIX5
  Gene Name: SIX homeobox 5
  ENSP ID: ENSP00000453239
  MOD_RES (1)..(1): Any amino acid
XPEAASEPPTGLRFSPEQVACVCEALLQAGHAGRLSRFLGALPPAERLRGSDPVLRARALVAFQRGEYAELYRLLESRPFPAAHHAFLQDLYLRARYHEAERARGRALGAVDKYRLRKKFPLPKTIWDGEETVYCFKERSRAALKACYRGNRYPTPDEKRRLATLTGLSLTQVSNWFKNRRQRDRTGAGGGAPCKRKLPPGQPCVWQPHRDGCGPAAGQDHPHRHLPHQHARLPGPAASPRPGPATEARDGHLRA

SEQ ID NO: 79471 - protein, 158 aa, Homo sapiens
  Payload ID: 15821
  Gene Symbol: SIX5
  Gene Name: SIX homeobox 5
  ENSP ID: ENSP00000481365
MATLPLKPETAISVPEGGLPVAPSPALPEAHALGTLSAQQPPPAAATTSSTSLPFSPDSPGLLPNFPAPPPEGLMLSPAAVPVWSAGLELSAGTEGLLEAEKGLGTQAPHTVLRLPDPDPEGLLLGATAGGEVDEGLEAEAKVLTQLQSVPVEEPLEL

SEQ ID NO: 79472 - protein, 246 aa, Homo sapiens
  Payload ID: 15822
  Gene Symbol: SIX6
  Gene Name: SIX homeobox 6
  Uniprot ID: O95475
  ENSP ID: ENSP00000328596
MFQLPILNFSPQQVAGVCETLEESGDVERLGRFLWSLPVAPAACEALNKNESVLRARAIVAFHGGNYRELYHILENHKFTKESHAKLQALWLEAHYQEAEKLRGRPLGPVDKYRVRKKFPLPRTIWDGEQKTHCFKERTRHLLREWYLQDPYPNPSKKRELAQATGLTPTQVGNWFKNRRQRDRAAAAKNRLQQQVLSQGSGRALRAEGDGTPEVLGVATSPAASLSSKAATSAISITSSDSECDI

SEQ ID NO: 79473 - protein, 339 aa, Homo sapiens
  Payload ID: 15823
  Gene Symbol: STEAP1
  Gene Name: six transmembrane epithelial antigen of the prostate 1
  Uniprot ID: Q9UHE8
  ENSP ID: ENSP00000297205
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 79474 - protein, 101 aa, Homo sapiens
  Payload ID: 15823
  Gene Symbol: STEAP1
  Gene Name: six transmembrane epithelial antigen of the prostate 1
  ENSP ID: ENSP00000394402
  MOD_RES (1)..(1): Any amino acid
XPMRRSYRYKLLNWAYQQVQQNKEDAWIEHDVWRMEIYVSLGIVGLAILALLAVTSIPSVSDSLTWREFHYIQIIHKKSDVPESLWDPCLTRFKGLNLIQS

SEQ ID NO: 79475 - protein, 408 aa, Homo sapiens
  Payload ID: 15824
  Gene Symbol: SSB
  Gene Name: Sjogren syndrome antigen B (autoantigen La)
  Uniprot ID: P05455
  ENSP ID: ENSP00000260956
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKEALKKIIEDQQESLNKWKSKGRRFKGKGKGNKAAQPGSGKGKVQFQGKKTKFASDDEHDEHDENGATGPVKRAREETDKEEPASKQQKTENGAGDQ

SEQ ID NO: 79476 - protein, 408 aa, Homo sapiens; identical to SEQ ID NO: 79475
  Payload ID: 15824
  Gene Symbol: SSB
  Gene Name: Sjogren syndrome antigen B (autoantigen La)
  Uniprot ID: P05455
  ENSP ID: ENSP00000386636

SEQ ID NO: 79477 - protein, 134 aa, Homo sapiens
  Payload ID: 15824
  Gene Symbol: SSB
  Gene Name: Sjogren syndrome antigen B (autoantigen La)
  ENSP ID: ENSP00000395758
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYISHPVAHVGVQWCDHGPLQS

SEQ ID NO: 79478 - protein, 120 aa, Homo sapiens
  Payload ID: 15824
  Gene Symbol: SSB
  Gene Name: Sjogren syndrome antigen B (autoantigen La)
  ENSP ID: ENSP00000396890
MIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETP

SEQ ID NO: 79479 - protein, 184 aa, Homo sapiens
  Payload ID: 15824
  Gene Symbol: SSB
  Gene Name: Sjogren syndrome antigen B (autoantigen La)
  ENSP ID: ENSP00000397029
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILF

SEQ ID NO: 79480 - protein, 119 aa, Homo sapiens
  Payload ID: 15825
  Gene Symbol: SSNA1
  Gene Name: Sjogren syndrome nuclear autoantigen 1
  Uniprot ID: O43805
  ENSP ID: ENSP00000313752
MTQQGAALQNYNNELVKCIEELCQKREELCRQIQEEEDEKQRLQNEVRQLTEKLARVNENLARKIASRNEFDRTIAETEAAYLKILESSQTLLSVLKREAGNLTKATAPDQKSSGGRDS

SEQ ID NO: 79481 - protein, 81 aa, Homo sapiens
  Payload ID: 15825
  Gene Symbol: SSNA1
  Gene Name: Sjogren syndrome nuclear autoantigen 1
  ENSP ID: ENSP00000479123
MTQQGAALQNYNNELVKCIEELCQKREELCRQIQEEEDEKQRLQNEILESSQTLLSVLKREAGNLTKATAPDQKSSGGRDS

SEQ ID NO: 79482 - protein, 199 aa, Homo sapiens
  Payload ID: 15826
  Gene Symbol: SSSCA1
  Gene Name: Sjogren syndrome/scleroderma autoantigen 1
  Uniprot ID: O60232
  ENSP ID: ENSP00000312318
MALNGAEVDDFSWEPPTEAETKVLQARRERQDRISRLMGDYLLRGYRMLGETCADCGTILLQDKQRKIYCVACQELDSDVDKDNPALNAQAALSQAREHQLASASELPLGSRPAPQPPVPRPEHCEGAAAGLKAAQGPPAPAVPPNTDVMACTQTALLQKLTWASAELGSSTSLETSIQLCGLIRACAEALRSLQQLQH

SEQ ID NO: 79483 - protein, 81 aa, Homo sapiens
  Payload ID: 15826
  Gene Symbol: SSSCA1
  Gene Name: Sjogren syndrome/scleroderma autoantigen 1
  ENSP ID: ENSP00000431666
MALNGAEVDDFSWEPPTEAETKVLQARRERQDRISRLMGDYLLRGYRMLGETRSSSKTNSGKSTAWLVRNSTQTWIKIIPL

SEQ ID NO: 79484 - protein, 60 aa, Homo sapiens
  Payload ID: 15826
  Gene Symbol: SSSCA1
  Gene Name: Sjogren syndrome/scleroderma autoantigen 1
  ENSP ID: ENSP00000432938
MGDYLLRGYRMLGETCADCGTILLQDKQRKIYCVACQELDSDVDKDNPALRDVVPQPLPF

SEQ ID NO: 79485 - protein, 162 aa, Homo sapiens
  Payload ID: 15826
  Gene Symbol: SSSCA1
  Gene Name: Sjogren syndrome/scleroderma autoantigen 1
  ENSP ID: ENSP00000434381
MGDYLLRGYRMLGETCADCGTILLQDKQRKIYCVACQELDSDVDKDNPALNAQAALSQAREHQLASASELPLGSRPAPQPPVPRPEHCEGAAAGLKAAQGPPAPAVPPNTDVMACTQTALLQKLTWASAELGSSTSLETSIQLCGLIRACAEALRSLQQLQH

SEQ ID NO: 79486 - protein, 193 aa, Homo sapiens
  Payload ID: 15826
  Gene Symbol: SSSCA1
  Gene Name: Sjogren syndrome/scleroderma autoantigen 1
  ENSP ID: ENSP00000435432
EVDDFSWEPPTEAETKVLQARRERQDRISRLMGDYLLRGYRMLGETCADCGTILLQDKQRKIYCVACQELDSDVDKDNPALNAQAALSQAREHQLASASELPLGSRPAPQPPVPRPEHCEGAAAGLKAAQGPPAPAVPPNTDVMACTQTALLQKLTWASAELGSSTSLETSIQLCGLIRACAEALRSLQQLQH

SEQ ID NO: 79487 - protein, 107 aa, Homo sapiens
  Payload ID: 15826
  Gene Symbol: SSSCA1
  Gene Name: Sjogren syndrome/scleroderma autoantigen 1
  ENSP ID: ENSP00000435982
  MOD_RES (1)..(1): Any amino acid
XISRLMGDYLLRGYRMLGETCADCGTILLQDKQRKIYCVACQELDSDVDKDNPGGAAAVGHVLVVPAVGPVRVNPGLQTPVPRPELLPGPVILPPFGQLLPTGCGPV

SEQ ID NO: 79488 - protein, 868 aa, Homo sapiens
  Payload ID: 15827
  Gene Symbol: SKOR1
  Gene Name: SKI family transcriptional corepressor 1
  Uniprot ID: P84550
  ENSP ID: ENSP00000343200
MIPKSLVQAAETQRGLCEPGGKGREGRSGGKGETRPRGVGTQEGKGTIPGSPREKRGERGEGDPALLPAEDLWRLPGSKDRLRSSLLPPPGPPSSDSGPGPPSSHSGKTAQGPRTLNWARKQSARTSSNLCAWSLAMATKMAEIPSSPYEPGQRGMKDTQRGDAPQRGSPEPRILQLARVGNVYLKEESSRSGRLEAKKWIPTKFLENLSVPHVDLGGNQLWSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDRGLGLATGASGPAGPGGPGGGAGVRSYPVIPVPSKGFGLLQKLPPPLFPHPYGFPTAFGLCPKKDDPVLGAGEPKGGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 79489 - protein, 965 aa, Homo sapiens
  Payload ID: 15827
  Gene Symbol: SKOR1
  Gene Name: SKI family transcriptional corepressor 1
  Uniprot ID: P84550
  ENSP ID: ENSP00000369374
MALLCGLGQVTLRIWVSLPSQSENGIGFLAARAFLRSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 79490 - protein, 926 aa, Homo sapiens
  Payload ID: 15827
  Gene Symbol: SKOR1
  Gene Name: SKI family transcriptional corepressor 1
  ENSP ID: ENSP00000451193
MEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 79491 - protein, 937 aa, Homo sapiens
  Payload ID: 15827
  Gene Symbol: SKOR1
  Gene Name: SKI family transcriptional corepressor 1
  ENSP ID: ENSP00000452361
MALLCGLGSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 79492 - protein, 296 aa, Homo sapiens
  Payload ID: 15828
  Gene Symbol: SKOR2
  Gene Name: SKI family transcriptional corepressor 2
  Uniprot ID: Q2VWA4
  ENSP ID: ENSP00000383255
MASSPLPGPNDILLASPSSAFQPDTLSQPRPGHANLKPNQVGQVILYGIPIVSLVIDGQERLCLAQISNTLLKNFSYNEIHNRRVALGITCVQCTPVQLEILRRAGAMPISSRRCGMITKREAERLCKSFLGENRPPKLPDNFAFDVSHECAWGCRGSFIPARYNSSRAKCIKCSYCNMYFSPNKFIFHSHRTPDAKYTQPDAANFNSWRRHLKLTDKSPQDELVFAWEDVKAMFNGGSRKRALPQPGAHPACHPLSSIRTRSIAFSSQTLMLLEEIFGEKDQEDYMRINEDNIWL

SEQ ID NO: 79493 - protein, 1001 aa, Homo sapiens
  Payload ID: 15828
  Gene Symbol: SKOR2
  Gene Name: SKI family transcriptional corepressor 2
  Uniprot ID: Q2VWA4
  ENSP ID: ENSP00000414750
MASSPLPGPNDILLASPSSAFQPDTLSQPRPGHANLKPNQVGQVILYGIPIVSLVIDGQERLCLAQISNTLLKNFSYNEIHNRRVALGITCVQCTPVQLEILRRAGAMPISSRRCGMITKREAERLCKSFLGENRPPKLPDNFAFDVSHECAWGCRGSFIPARYNSSRAKCIKCSYCNMYFSPNKFIFHSHRTPDAKYTQPDAANFNSWRRHLKLTDKSPQDELVFAWEDVKAMFNGGSRKRALPQPGAHPACHPLSSVKAAAVAAAAAVAGGGGLLGPHLLGAPPPPPPPPPPLAELAGAPHAHHKRPRFDDDDDSLQEAAVVAAASLSAAAASLSVAAASGGAGTGGGGAGGGCVAGVGVGAGAGAGAGAGAKGPRSYPVIPVPSKGSFGGVLQKFPGCGGLFPHPYTFPAAAAAFSLCHKKEDAGAAAEALGGAGAGGAGAAPKAGLSGLFWPAGRKDAFYPPFCMFWPPRTPGGLPVPTYLQPPPQPPSALGCALGESPALLRQAFLDLAEPGGAAGSAEAAPPPGQPPQVVANGPGSGPPPPAGGAGSRDALFESPPGGSGGDCSAGSTPPADSVAAAGAGAAAAGSGPAGSRVPAPHHPHLLEGRKAGGGSYHHSSAFRPVGGKDDAESLAKLHGASAGAPHSAQTHPHHHHHPHHHHHHHHPPQPPSPLLLLPPQPDEPGSERHHPAPPPPPPPPPPPPLAQHPHHRGLLSPGGTSCCYPSEDSSEDEDDEEEEQEVDVEGHKPPEGEEEEEGRDPDDDEEEDEETEVLLGDPLVGGGRFLQGRGPSEKGSSRDRAPAVAGAFPLGLNSSRLLQEDGKLGDPGSDLPPPPPPPLAPQKASGGGSSSPGSPVHHPSLEEQPSYKDSQKTKENNQVIVSTKDDNSFSDKNKEHSFFITDSDASGGDFWRERSGEHTQETNSPHSLKKDVENMGKEELQKVLFEQIDLRRRLEQEFQVLKGNTSFPVFNNFQDQMKRELAYREEMVQQLQIVSCIST

SEQ ID NO: 79494 - protein, 1015 aa, Homo sapiens
  Payload ID: 15828
  Gene Symbol: SKOR2
  Gene Name: SKI family transcriptional corepressor 2
  ENSP ID: ENSP00000483333
MASSPLPGPNDILLASPSSAFQPDTLSQPRPGHANLKPNQVGQVILYGIPIVSLVIDGQERLCLAQISNTLLKNFSYNEIHNRRVALGITCVQCTPVQLEILRRAGAMPISSRRCGMITKREAERLCKSFLGENRPPKLPDNFAFDVSHECAWGCRGSFIPARYNSSRAKCIKCSYCNMYFSPNKFIFHSHRTPDAKYTQPDAANFNSWRRHLKLTDKSPQDELVFAWEDVKAMFNGGSRKRALPQPGAHPACHPLSSVKAAAVAAAAAVAGGGGLLGPHLLGAPPPPPPPPPPLAELAGAPHAHHKRPRFDDDDDSLQEAAVVAAASLSAAAASLSVAAASGGAGTGGGGAGGGCVAGVGVGAGAGAGAGAGAKGPRSYPVIPVPSKGSFGGVLQKFPGCGGLFPHPYTFPAAAAAFSLCHKKEDAGAAAEALGGAGAGGAGAAPKAGLSGLFWPAGRKDAFYPPFCMFWPPRTPGGLPVPTYLQPPPQPPSALGCALGESPALLRQAFLDLAEPGGAAGSAEAAPPPGQPPQVVANGPGSGPPPPAGGAGSRDALFESPPGGSGGDCSAGSTPPADSVAAAGAGAAAAGSGPAGSRVPAPHHPHLLEGRKAGGGSYHHSSAFRPVGGKDDAESLAKLHGASAGAPHSAQTHPHHHHHPHHHHHHHHPPQPPSPLLLLPPQPDEPGSERHHPAPPPPPPPPPPPPLAQHPHHRGLLSPGGTSCCYPSEDSSEDEDDEEEEQEVDVEGHKPPEGEEEEEGRDPDDDEEEDEETEVLLGDPLVGGGRFLQGRGPSEKGSSRDRAPAVAGAFPLGLNSSRLLQEDGKLGDPGSDLPPPPPPPLAPQKASGGGSSSPGSPVHHPSLEEQPSYKDSQKTKENNQVIVSTKDDNSFSDKNKEHSFFITDSDASGGDFWRERSGEHTQETNSPHSLKKDVENMGKEELQKVLFEQIDLRRRLEQEFQVLKGNTSFPVFNNFQDQMKRELAYREEMVQQLQIIPYAASLIRKEKLGAHLSKS

SEQ ID NO: 79495 - protein, 728 aa, Homo sapiens
  Payload ID: 15829
  Gene Symbol: SKI
  Gene Name: SKI proto-oncogene
  Uniprot ID: P12755
  ENSP ID: ENSP00000367797
MEAAAGGRGCFQPHPGLQKTLEQFHLSSMSSLGGPAAFSARWAQEAYKKESAKEAGAAAVPAPVPAATEPPPVLHLPAIQPPPPVLPGPFFMPSDRSTERCETVLEGETISCFVVGGEKRLCLPQILNSVLRDFSLQQINAVCDELHIYCSRCTADQLEILKVMGILPFSAPSCGLITKTDAERLCNALLYGGAYPPPCKKELAASLALGLELSERSVRVYHECFGKCKGLLVPELYSSPSAACIQCLDCRLMYPPHKFVVHSHKALENRTCHWGFDSANWRAYILLSQDYTGKEEQARLGRCLDDVKEKFDYGNKYKRRVPRVSSEPPASIRPKTDDTSSQSPAPSEKDKPSSWLRTLAGSSNKSLGCVHPRQRLSAFRPWSPAVSASEKELSPHLPALIRDSFYSYKSFETAVAPNVALAPPAQQKVVSSPPCAAAVSRAPEPLATCTQPRKRKLTVDTPGAPETLAPVAAPEEDKDSEAEVEVESREEFTSSLSSLSSPSFTSSSSAKDLGSPGARALPSAVPDAAAPADAPSGLEAELEHLRQALEGGLDTKEAKEKFLHEVVKMRVKQEEKLSAALQAKRSLHQELEFLRVAKKEKLREATEAKRNLRKEIERLRAENEKKMKEANESRLRLKRELEQARQARVCDKGCEAGRLRAKYSAQIEDLQVKLQHAEADREQLRADLLREREAREHLEKVVKELQEQLWPRARPEAAGSEGAAELEP

SEQ ID NO: 79496 - protein, 908 aa, Homo sapiens
  Payload ID: 15830
  Gene Symbol: SKIDA1
  Gene Name: SKI/DACH domain containing 1
  ENSP ID: ENSP00000410041
MGDLKSGFEEVDGVRLGYLIIKGKQMFALSQVFTDLLKNIPRTTVHKRMDHLKVKKHHCDLEELRKLKAINSIAFHAAKCTLISREDVEALYTSCKTERVLKTKRRRVGRALATKAPPPERAAAASPRPGFWKDKHQLWRGLSGAARPLPISAQSQRPGAAAARPAAHLPQIFSKYPGSHYPEIVRSPCKPPLNYETAPLQGNYVAFPSDPAYFRSLLCSKHPAAAAAAAAAAAAAAAAAAAAAYYQVSAAGPQPKAAAGAGGPGSLSYRCKRKRGGAKDCLLAPHAGARRLLLLPRSYKAKAAAAAAAAAAAAAAAAGATCLERFHLVNGFCPPPHHHHHHHHHHHHHHHRAQPPQQSHHPPHHHRPQPHLGSFPESCSSDSESSSYSDHAANDSDFGSSLSSSSNSVSSEEEEEEGEEEEEEEEEEGGSGASDSSEVSSEEEDSSTESDSSSGSSQVSVQSIRFRRTSFCKPPSVQAQANFLYHLASAAAATKPAAFEDAGRLPDLKSSVKAESPAEWNLQSWAPKASPVYCPASLGSCFAEIRNDRVSEITFPHSEISNAVKRTDLTINCLAEGASSPSPKTNNAFPQQRILREARKCLQTTPTTHCADNNTIAARFLNNDSSGAEANSEKYSKILHCPEFATDLPSSQTDPEVNAAGAAATKAENPCTDTGDKTLPFLHNIKIKVEDSSANEEYEPHLFTNKLKCECNDTKGEFYSVTESKEEDALLTTAKEGFACPEKETPSLNPLAQSQGLSCTLGSPKPEDGEYKFGARVRKNYRTLVLGKRPVLQTPPVKPNLKSARSPRPTGKTETNEGTLDDFTVINRRKKVASNVASAVKRPFHFMANFPCPPSLIIGRDGDLWPAYSLNTTKDSQTPHKAHPIWKWQLGGSAIPLPPSHKFRKFNS

SEQ ID NO: 79497 - protein, 829 aa, Homo sapiens
  Payload ID: 15830
  Gene Symbol: SKIDA1
  Gene Name: SKI/DACH domain containing 1
  ENSP ID: ENSP00000442432
MGDLKSGFEEVDGVRLGYLIIKGKQMFALSQVFTDLLKNIPRTTVHKRMDHLKVKKHHCDLEELRKLKAINSIAFHAAKCTLISREDVEALYTSCKTERVLKTKRRRVGRALATKAPPPERAAAASPRPGFWKDKHQLWRGLSGAARPLPISAQSQRPGAAAARPAAHLPQIFSKYPGSHYPEIVRSPCKPPLNYETAPLQGNYVAFPSDPAYFRSLLCSKHPAAAAAAAAAAAAAAAAGATCLERFHLVNGFCPPPHHHHHHHHHHHHHHHRAQPPQQSHHPPHHHRPQPHLGSFPESCSSDSESSSYSDHAANDSDFGSSLSSSSNSVSSEEEEEEGEEEEEEEEEEGGSGASDSSEVSSEEEDSSTESDSSSGSSQVSVQSIRFRRTSFCKPPSVQAQANFLYHLASAAAATKPAAFEDAGRLPDLKSSVKAESPAEWNLQSWAPKASPVYCPASLGSCFAEIRNDRVSEITFPHSEISNAVKRTDLTINCLAEGASSPSPKTNNAFPQQRILREARKCLQTTPTTHCADNNTIAARFLNNDSSGAEANSEKYSKILHCPEFATDLPSSQTDPEVNAAGAAATKAENPCTDTGDKTLPFLHNIKIKVEDSSANEEYEPHLFTNKLKCECNDTKGEFYSVTESKEEDALLTTAKEGFACPEKETPSLNPLAQSQGLSCTLGSPKPEDGEYKFGARVRKNYRTLVLGKRPVLQTPPVKPNLKSARSPRPTGKTETNEGTLDDFTVINRRKKVASNVASAVKRPFHFMANFPCPPSLIIGRDGDLWPAYSLNTTKDSQTPHKAHPIWKWQLGGSAIPLPPSHKFRKFNS

SEQ ID NO: 79498 - protein, 1246 aa, Homo sapiens
  Payload ID: 15831
  Gene Symbol: SKIV2L
  Gene Name: SKI2 homolog, superkiller viralicidic activity 2-like
  Uniprot ID: Q15477
  ENSP ID: ENSP00000364543
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTQYPFWPGGMDEPTITDLNTREEAEEEIDFEKDLLTIPPGFKKGMDFAPKDCPTPAPGLLSLSCMLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 79499 - protein, 1246 aa, Homo sapiens
  Payload ID: 15831
  Gene Symbol: SKIV2L
  Gene Name: SKI2 homolog, superkiller viralicidic activity 2-like
  Uniprot ID: Q15477
  ENSP ID: ENSP00000372827
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTQYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 79500 - protein, 1246 aa, Homo sapiens; identical to SEQ ID NO: 79498
  Payload ID: 15831
  Gene Symbol: SKIV2L
  Gene Name: SKI2 homolog, superkiller viralicidic activity 2-like
  Uniprot ID: Q15477
  ENSP ID: ENSP00000394400

SEQ ID NO: 79501 - protein, 1246 aa, Homo sapiens; identical to SEQ ID NO: 79499
  Payload ID: 15831
  Gene Symbol: SKIV2L
  Gene Name: SKI2 homolog, superkiller viralicidic activity 2-like
  Uniprot ID: Q15477
  ENSP ID: ENSP00000399530

SEQ ID NO: 79502 - protein, 1246 aa, Homo sapiens; identical to SEQ ID NO: 79499
  Payload ID: 15831
  Gene Symbol: SKIV2L
  Gene Name: SKI2 homolog, superkiller viralicidic activity 2-like
  Uniprot ID: Q15477
  ENSP ID: ENSP00000400626

SEQ ID NO: 79503 - protein, 1246 aa, Homo sapiens; identical to SEQ ID NO: 79499
  Payload ID: 15831
  Gene Symbol: SKIV2L
  Gene Name: SKI2 homolog, superkiller viralicidic activity 2-like
  Uniprot ID: Q15477
  ENSP ID: ENSP00000412310

SEQ ID NO: 79504 - protein, 182 aa, Homo sapiens
  Payload ID: 15831
  Gene Symbol: SKIV2L
  Gene Name: SKI2 homolog, superkiller viralicidic activity 2-like
  ENSP ID: ENSP00000417586
  MOD_RES (1)..(1): Any amino acid
XRKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMVST

SEQ ID NO: 79505 - protein, 230 aa, Homo sapiens
  Payload ID: 15831
  Gene Symbol: SKIV2L
  Gene Name: SKI2 homolog, superkiller viralicidic activity 2-like
  ENSP ID: ENSP00000419905
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTQYPFWPGGMDEPTITDLNTREEAEEEIDFEKDLLTIPPGFKKGMDFAPKGSVHSCIHPRGPRASISGAVGHPCGRHLPCW

SEQ ID NO: 79506 - protein, 156 aa, Homo sapiens
  Payload ID: 15831
  Gene Symbol: SKIV2L
  Gene Name: SKI2 homolog, superkiller viralicidic activity 2-like
  ENSP ID: ENSP00000420332
  MOD_RES (1)..(1): Any amino acid
XCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQPLSSVHPC

SEQ ID NO: 79507 - protein, 69 aa, Homo sapiens
  Payload ID: 15831
  Gene Symbol: SKIV2L
  Gene Name: SKI2 homolog, superkiller viralicidic activity 2-like
  ENSP ID: ENSP00000420470
MMETERLVLPPPDPLDLPLRAVELGCTGHWELLNLPGAPESSIFLLFHLVSRKAWTLHQKIVQLQLLDY

SEQ ID NO: 79508 - protein, 69 aa, Homo sapiens; identical to SEQ ID NO: 79507
  Payload ID: 15831
  Gene Symbol: SKIV2L
  Gene Name: SKI2 homolog, superkiller viralicidic activity 2-like
  ENSP ID: ENSP00000485707

SEQ ID NO: 79509 - protein, 69 aa, Homo sapiens; identical to SEQ ID NO: 79507
  Payload ID: 15831
  Gene Symbol: SKIV2L
  Gene Name: SKI2 homolog, superkiller viralicidic activity 2-like
  ENSP ID: ENSP00000486288

SEQ ID NO: 79510 - protein, 69 aa, Homo sapiens; identical to SEQ ID NO: 79507
  Payload ID: 15831
  Gene Symbol: SKIV2L
  Gene Name: SKI2 homolog, superkiller viralicidic activity 2-like
  ENSP ID: ENSP00000486387

SEQ ID NO: 79511 - protein, 69 aa, Homo sapiens; identical to SEQ ID NO: 79507
  Payload ID: 15831
  Gene Symbol: SKIV2L
  Gene Name: SKI2 homolog, superkiller viralicidic activity 2-like
  ENSP ID: ENSP00000486559

SEQ ID NO: 79512 - protein, 69 aa, Homo sapiens; identical to SEQ ID NO: 79507
  Payload ID: 15831
  Gene Symbol: SKIV2L
  Gene Name: SKI2 homolog, superkiller viralicidic activity 2-like
  ENSP ID: ENSP00000486630

SEQ ID NO: 79513 - protein, 69 aa, Homo sapiens; identical to SEQ ID NO: 79507
  Payload ID: 15831
  Gene Symbol: SKIV2L
  Gene Name: SKI2 homolog, superkiller viralicidic activity 2-like
  ENSP ID: ENSP00000486656

SEQ ID NO: 79514 - protein, 684 aa, Homo sapiens
  Payload ID: 15832
  Gene Symbol: SKIL
  Gene Name: SKI-like proto-oncogene
  Uniprot ID: P12757
  ENSP ID: ENSP00000259119
MENLQTNFSLVQGSTKKLNGMGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPSYYLYMCDKVVAPNVSLTSAVSQSKELTKTEASKSISRQSEKAHSSGKLQKTVSYPDVSLEEQEKMDLKTSRELCSRLDASISNNSTSKRKSESATCNLVRDINKVGIGLVAAASSPLLVKDVICEDDKGKIMEEVMRTYLKQQEKLNLILQKKQQLQMEVKMLSSSKSMKELTEEQQNLQKELESLQNEHAQRMEEFYVEQKDLEKKLEQIMKQKCTCDSNLEKDKEAEYAGQLAELRQRLDHAEADRQELQDELRQEREARQKLEMMIKELKLQILKSSKTAKE

SEQ ID NO: 79515 - protein, 638 aa, Homo sapiens
  Payload ID: 15832
  Gene Symbol: SKIL
  Gene Name: SKI-like proto-oncogene
  Uniprot ID: P12757
  ENSP ID: ENSP00000400193
MENLQTNFSLVQGSTKKLNGMGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPSYYLYMCDKVVAPNVSLTSAVSQSKELTKTEANASISNNSTSKRKSESATCNLVRDINKVGIGLVAAASSPLLVKDVICEDDKGKIMEEVMRTYLKQQEKLNLILQKKQQLQMEVKMLSSSKSMKELTEEQQNLQKELESLQNEHAQRMEEFYVEQKDLEKKLEQIMKQKCTCDSNLEKDKEAEYAGQLAELRQRLDHAEADRQELQDELRQEREARQKLEMMIKELKLQILKSSKTAKE

SEQ ID NO: 79516 - protein, 664 aa, Homo sapiens
  Payload ID: 15832
  Gene Symbol: SKIL
  Gene Name: SKI-like proto-oncogene
  Uniprot ID: P12757
  ENSP ID: ENSP00000406520
MGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPSYYLYMCDKVVAPNVSLTSAVSQSKELTKTEASKSISRQSEKAHSSGKLQKTVSYPDVSLEEQEKMDLKTSRELCSRLDASISNNSTSKRKSESATCNLVRDINKVGIGLVAAASSPLLVKDVICEDDKGKIMEEVMRTYLKQQEKLNLILQKKQQLQMEVKMLSSSKSMKELTEEQQNLQKELESLQNEHAQRMEEFYVEQKDLEKKLEQIMKQKCTCDSNLEKDKEAEYAGQLAELRQRLDHAEADRQELQDELRQEREARQKLEMMIKELKLQILKSSKTAKE

SEQ ID NO: 79517 - protein, 684 aa, Homo sapiens; identical to SEQ ID NO: 79514
  Payload ID: 15832
  Gene Symbol: SKIL
  Gene Name: SKI-like proto-oncogene
  Uniprot ID: P12757
  ENSP ID: ENSP00000415243

SEQ ID NO: 79518 - protein, 123 aa, Homo sapiens
  Payload ID: 15832
  Gene Symbol: SKIL
  Gene Name: SKI-like proto-oncogene
  ENSP ID: ENSP00000417670
MENLQTNFSLVQGSTKKLNGMGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLP

SEQ ID NO: 79519 - protein, 111 aa, Homo sapiens
  Payload ID: 15832
  Gene Symbol: SKIL
  Gene Name: SKI-like proto-oncogene
  ENSP ID: ENSP00000418237
  MOD_RES (1)..(1): Any amino acid
XCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPRCINLK

SEQ ID NO: 79520 - protein, 349 aa, Homo sapiens
  Payload ID: 15833
  Gene Symbol: SLAIN1
  Gene Name: SLAIN motif family, member 1
  ENSP ID: ENSP00000267219
MEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 79521 - protein, 191 aa, Homo sapiens
  Payload ID: 15833
  Gene Symbol: SLAIN1
  Gene Name: SLAIN motif family, member 1
  Uniprot ID: Q8ND83
  ENSP ID: ENSP00000314443
MGYKLQDLTDVQIMARLQEENKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 79522 - protein, 304 aa, Homo sapiens
  Payload ID: 15833
  Gene Symbol: SLAIN1
  Gene Name: SLAIN motif family, member 1
  ENSP ID: ENSP00000314546
MRLPLGIYRQRGRFRHFSPGLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 79523 - protein, 305 aa, Homo sapiens
  Payload ID: 15833
  Gene Symbol: SLAIN1
  Gene Name: SLAIN motif family, member 1
  Uniprot ID: Q8ND83
  ENSP ID: ENSP00000351507
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 79524 - protein, 79 aa, Homo sapiens
  Payload ID: 15833
  Gene Symbol: SLAIN1
  Gene Name: SLAIN motif family, member 1
  ENSP ID: ENSP00000366444
MNRLYIGSSKTFTSSEKSLTPLQWCRHVLDNPTPEMEAARRSLCFRLEQGYTSRGSPLSPQSSIDSELSTSELEDDSIS

SEQ ID NO: 79525 - protein, 111 aa, Homo sapiens
  Payload ID: 15833
  Gene Symbol: SLAIN1
  Gene Name: SLAIN motif family, member 1
  ENSP ID: ENSP00000389195
MEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFD

SEQ ID NO: 79526 - protein, 205 aa, Homo sapiens
  Payload ID: 15833
  Gene Symbol: SLAIN1
  Gene Name: SLAIN motif family, member 1
  ENSP ID: ENSP00000393990
MEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPV

SEQ ID NO: 79527 - protein, 590 aa, Homo sapiens
  Payload ID: 15833
  Gene Symbol: SLAIN1
  Gene Name: SLAIN motif family, member 1
  ENSP ID: ENSP00000400921
MMAEQVKCASAGVSSGAGSGPVVNAELEVKKLQELVRKLEKQNEQLRSRAASAAAAPHLLLLPPPPPAAPPPAGLQPLGPRSPPAATATAAASGGLGLGLALGAGGGGGSGSGSGGGSSPAFPGTFCLPSPAPSLLCSLAQPPEAPFVYFKPAAGFFGAGGGGPEPGGAGTPPGAAAAPPSPPPTLLDEVELLDLESVAAWRDEDDYTWLYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 79528 - protein, 228 aa, Homo sapiens
  Payload ID: 15833
  Gene Symbol: SLAIN1
  Gene Name: SLAIN motif family, member 1
  ENSP ID: ENSP00000403049
MEAARRSLCFRLEQASRWRSLFSSTASLAFPYSPVARLSPYSNGINTPSFSKTSNKAILTPEKTGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNG

SEQ ID NO: 79529 - protein, 240 aa, Homo sapiens
  Payload ID: 15833
  Gene Symbol: SLAIN1
  Gene Name: SLAIN motif family, member 1
  ENSP ID: ENSP00000403056
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTG

SEQ ID NO: 79530 - protein, 12 aa, Homo sapiens
  Payload ID: 15833
  Gene Symbol: SLAIN1
  Gene Name: SLAIN motif family, member 1
  ENSP ID: ENSP00000418053
MGYKLQDLTDVQ

SEQ ID NO: 79531 - protein, 426 aa, Homo sapiens
  Payload ID: 15833
  Gene Symbol: SLAIN1
  Gene Name: SLAIN motif family, member 1
  Uniprot ID: Q8ND83
  ENSP ID: ENSP00000418707
MVGVGLCLRLLLFFRFKRTLDRICVLFLLGWHRKPRSDGSLFIERLYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 79532 - protein, 147 aa, Homo sapiens
  Payload ID: 15833
  Gene Symbol: SLAIN1
  Gene Name: SLAIN motif family, member 1
  ENSP ID: ENSP00000419436
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARM

SEQ ID NO: 79533 - protein, 568 aa, Homo sapiens
  Payload ID: 15833
  Gene Symbol: SLAIN1
  Gene Name: SLAIN motif family, member 1
  Uniprot ID: Q8ND83
  ENSP ID: ENSP00000419730
MMAEQVKCASAGVSSGAGSGPVVNAELEVKKLQELVRKLEKQNEQLRSRAASAAAAPHLLLLPPPPPAAPPPAGLQPLGPRSPPAATATAAASGGLGPAFPGTFCLPSPAPSLLCSLAQPPEAPFVYFKPAAGFFGAGGGGPEPGGAGTPPGAAAAPPSPPPTLLDEVELLDLESVAAWRDEDDYTWLYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 79534 - protein, 99 aa, Homo sapiens
  Payload ID: 15833
  Gene Symbol: SLAIN1
  Gene Name: SLAIN motif family, member 1
  ENSP ID: ENSP00000420320
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECR

SEQ ID NO: 79535 - protein, 135 aa, Homo sapiens
  Payload ID: 15833
  Gene Symbol: SLAIN1
  Gene Name: SLAIN motif family, member 1
  ENSP ID: ENSP00000420619
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGG

SEQ ID NO: 79536 - protein, 581 aa, Homo sapiens [sequence omitted]

SEQ ID NO: 79537 - protein, 169 aa, Homo sapiens
  Payload ID: 15834
  Gene Symbol: SLAIN2
  Gene Name: SLAIN motif family, member 2
  ENSP ID: ENSP00000424473
  MOD_RES (1)..(1): Any amino acid
XRTSNTQVDSVKSSRSDSNFQVPNGGIPRMQPQASATSQRLKNLPRTSLKAKQLLQTSSTKRVPSPGKFRSPAAPSPLALRQPVKAFSNHGSGSPGSQEITQLTQTTSSPGPPMVQSTVSANPPSNINSATLTRPAGTTAMRSGLPRPSAPSAGGIPVPRSKLAQPVRR

SEQ ID NO: 79538 - protein, 414 aa, Homo sapiens
  Payload ID: 15834
  Gene Symbol: SLAIN2
  Gene Name: SLAIN motif family, member 2
  ENSP ID: ENSP00000425923
MSYTSPYSPNASSPYSSGFNSPSSTPVRPPIVKQLILPGNSGNLKSSDRNPPLSPQSSIDSELSASELDEDSIGSNYKLNDVTDVQILARMQEESLRQEYAATTSRRSSGSSCNSTRRGTFSDQELDAQSLDDEDDNMHHAVYPAVNRFSPSPRNSPRPSPKQSPRNSPRSRSPARGIEYSRVSPQPMISRLQQPRLSLQGHPTDLQTSNVKNEEKLRRSLPNLSRTSNTQVDSVKSSRSDSNFQVPNGGIPRMQPQASATSQRLKNLPRTSLKAKQLLQTSSTKRVPSPGKFRSPAAPSPLALRQPVKAFSNHGSGSPGSQEITQLTQTTSSPGPPMVQSTVSANPPSNINSATLTRPAGTTAMRSGLPRPSAPSAGGIPVPRSKLAQPVRRSLPAPKTYGSMKDDSWKDGCY

SEQ ID NO: 79539 - protein, 58 aa, Homo sapiens
  Payload ID: 15834
  Gene Symbol: SLAIN2
  Gene Name: SLAIN motif family, member 2
  ENSP ID: ENSP00000426744
MQEESLRQEYAATTSRRSSGSSCNSTRRGFHHHHAIHLDRHLSSHPEIHLVHDLLLGE

SEQ ID NO: 79540 - protein, 221 aa, Homo sapiens
  Payload ID: 15835
  Gene Symbol: SLAMF6
  Gene Name: SLAM family member 6
  Uniprot ID: Q96DU3
  ENSP ID: ENSP00000357034
MLWLFQSLLFVFCFGPGQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPAESARNLEYVSVSPTNNTVYASVTHSNRETEIWTPRENDTITIYSTINHSKESKPTFSRATALDNVV

SEQ ID NO: 79541 - protein, 332 aa, Homo sapiens
  Payload ID: 15835
  Gene Symbol: SLAMF6
  Gene Name: SLAM family member 6
  Uniprot ID: Q96DU3
  ENSP ID: ENSP00000357036
MLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPAESARNLEYVSVSPTNNTVYASVTHSNRETEIWTPRENDTITIYSTINHSKESKPTFSRATALDNVV

SEQ ID NO: 79542 - protein, 331 aa, Homo sapiens
  Payload ID: 15835
  Gene Symbol: SLAMF6
  Gene Name: SLAM family member 6
  Uniprot ID: Q96DU3
  ENSP ID: ENSP00000357038
MLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPESARNLEYVSVSPTNNTVYASVTHSNRETEIWTPRENDTITIYSTINHSKESKPTFSRATALDNVV

SEQ ID NO: 79543 - protein, 296 aa, Homo sapiens
  Payload ID: 15836
  Gene Symbol: SLAMF7
  Gene Name: SLAM family member 7
  Uniprot ID: Q9NQ25
  ENSP ID: ENSP00000352281
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEENNPKGRSSKYGLLHCGNTEKDGKSPLTAHDARHTKAICL

SEQ ID NO: 79544 - protein, 228 aa, Homo sapiens
  Payload ID: 15836
  Gene Symbol: SLAMF7
  Gene Name: SLAM family member 7
  Uniprot ID: Q9NQ25
  ENSP ID: ENSP00000357021
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 79545 - protein, 335 aa, Homo sapiens
  Payload ID: 15836
  Gene Symbol: SLAMF7
  Gene Name: SLAM family member 7
  Uniprot ID: Q9NQ25
  ENSP ID: ENSP00000357022
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 79546 - protein, 149 aa, Homo sapiens
  Payload ID: 15836
  Gene Symbol: SLAMF7
  Gene Name: SLAM family member 7
  ENSP ID: ENSP00000403294
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEENNPKGRSSKYGLLHCGNTEKDGKSPLTAHDARHTKAICL

SEQ ID NO: 79547 - protein, 204 aa, Homo sapiens
  Payload ID: 15836
  Gene Symbol: SLAMF7
  Gene Name: SLAM family member 7
  Uniprot ID: Q9NQ25
  ENSP ID: ENSP00000405605
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEYIEEKKRVDICRETPNICPHSGENTEYDTIPHTNRTILKEDPANTVYSTVEIPKKMENPHSLLTMPDTPRLFAYENVI

SEQ ID NO: 79548 - protein, 188 aa, Homo sapiens
  Payload ID: 15836
  Gene Symbol: SLAMF7
  Gene Name: SLAM family member 7
  Uniprot ID: Q9NQ25
  ENSP ID: ENSP00000409965
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEEYIEEKKRVDICRETPNICPHSGENTEYDTIPHTNRTILKEDPANTVYSTVEIPKKMENPHSLLTMPDTPRLFAYENVI

SEQ ID NO: 79549 - protein, 165 aa, Homo sapiens
  Payload ID: 15836
  Gene Symbol: SLAMF7
  Gene Name: SLAM family member 7
  Uniprot ID: Q9NQ25
  ENSP ID: ENSP00000416592
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYENNPKGRSSKYGLLHCGNTEKDGKSPLTAHDARHTKAICL

SEQ ID NO: 79550 - protein, 236 aa, Homo sapiens
  Payload ID: 15836
  Gene Symbol: SLAMF7
  Gene Name: SLAM family member 7
  ENSP ID: ENSP00000473590
  MOD_RES (1)..(1): Any amino acid
XAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEENNPKGRSSKYGLLHCGNTE

SEQ ID NO: 79551 - protein, 241 aa, Homo sapiens
  Payload ID: 15836
  Gene Symbol: SLAMF7
  Gene Name: SLAM family member 7
  ENSP ID: ENSP00000483774
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEGDCLSPLHRRLCPGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 79552 - protein, 285 aa, Homo sapiens
  Payload ID: 15837
  Gene Symbol: SLAMF8
  Gene Name: SLAM family member 8
  Uniprot ID: Q9P0V8
  ENSP ID: ENSP00000289707
MVMRPLWSLLLWEALLPITVTGAQVLSKVGGSVLLVAARPPGFQVREAIWRSLWPSEELLATFFRGSLETLYHSRFLGRAQLHSNLSLELGPLESGDSGNFSVLMVDTRGQPWTQTLQLKVYDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 79553 - protein, 176 aa, Homo sapiens
  Payload ID: 15837
  Gene Symbol: SLAMF8
  Gene Name: SLAM family member 8
  Uniprot ID: Q9P0V8
  ENSP ID: ENSP00000357084
MVMRPLWSLLLWEDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 79554 - protein, 198 aa, Homo sapiens
  Payload ID: 15838
  Gene Symbol: SLAMF9
  Gene Name: SLAM family member 9
  Uniprot ID: Q96A28
  ENSP ID: ENSP00000357071
MCAFPWLLLLLLLQEGSQRRLWRWCGSEEVVAVLQESISLPLEIPPDEEVENIIWSSHKSLATVVPGKEGHPATIMVTNPHYQGQVSFLDPSYSLHISNLSWEDSGLYQAQVNLRTSQISTMQQYNICVYHPNYASEKPSTAFCLLAKGLLIFLLLVILAMGLWVIRVQKRHKMPRMKKLMRNRMKLRKEAKPGSSPA

SEQ ID NO: 79555 - protein, 289 aa, Homo sapiens
  Payload ID: 15838
  Gene Symbol: SLAMF9
  Gene Name: SLAM family member 9
  Uniprot ID: Q96A28
  ENSP ID: ENSP00000357072
MCAFPWLLLLLLLQEGSQRRLWRWCGSEEVVAVLQESISLPLEIPPDEEVENIIWSSHKSLATVVPGKEGHPATIMVTNPHYQGQVSFLDPSYSLHISNLSWEDSGLYQAQVNLRTSQISTMQQYNICVYRWLSEPQITVNFESSGEGACSMSLVCSVEKAGMDMTYSWLSRGDSTYTFHEGPVLSTSWRPGDSALSYTCRANNPISNVSSCPIPDGPFYADPNYASEKPSTAFCLLAKGLLIFLLLVILAMGLWVIRVQKRHKMPRMKKLMRNRMKLRKEAKPGSSPA

SEQ ID NO: 79556 - protein, 387 aa, Homo sapiens
  Payload ID: 15839
  Gene Symbol: SLC2A4RG
  Gene Name: SLC2A4 regulator
  Uniprot ID: Q9NR83
  ENSP ID: ENSP00000266077
MERPPPRAAGRDPSALRAEAPWLRAEGPGPRAAPVTVPTPPQGSSVGGGFAGLEFARPQESEPRASDLGAPRTWTGAAAGPRTPSAHIPVPAQRATPGKARLDEVMAAAALTSLSTSPLLLGAPVAAFSPEPGLEPWKEALVRPPGSYSSSSNSGDWGWDLASDQSSPSTPSPPLPPEAAHFLFGEPTLRKRKSPAQVMFQCLWKSCGKVLSTASAMQRHIRLVHLGRQAEPEQSDGEEDFYYTELDVGVDTLTDGLSSLTPVSPTASMPPAFPRLELPELLEPPALPSPLRPPAPPLPPPPVLSTVANPQSCHSDRVYQGCLTPARLEPQPTEVGACPPALSSRIGVTLRKPRGDAKKCRKVYGMERRDLWCTACRWKKACQRFLD

SEQ ID NO: 79557 - protein, 1049 aa, Homo sapiens
  Payload ID: 15840
  Gene Symbol: SSH1
  Gene Name: slingshot protein phosphatase 1
  Uniprot ID: Q8WYL5
  ENSP ID: ENSP00000315713
MALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEDDAIFGILNKVKPSYKSCADCMYPTASGAPEASRERCEDPNAPAICTQPAFLPHITSSPVAHLASRSRVPEKPASGPTEPPPFLPPAGSRRADTSGPGAGAALEPPASLLEPSRETPKVLPKSLLLKNSHCDKNPPSTEVVIKEESSPKKDMKPAKDLRLLFSNESEKPTTNSYLMQHQESIIQLQKAGLVRKHTKELERLKSVPADPAPPSRDGPASRLEASIPEESQDPAALHELGPLVMPSQAGSDEKSEAAPASLEGGSLKSPPPFFYRLDHTSSFSKDFLKTICYTPTSSSMSSNLTRSSSSDSIHSVRGKPGLVKQRTQEIETRLRLAGLTVSSPLKRSHSLAKLGSLTFSTEDLSSEADPSTVADSQDTTLSESSFLHEPQGTPRDPAATSKPSGKPAPENLKSPSWMSKS

SEQ ID NO: 79558 - protein, 703 aa, Homo sapiens
  Payload ID: 15840
  Gene Symbol: SSH1
  Gene Name: slingshot protein phosphatase 1
  Uniprot ID: Q8WYL5
  ENSP ID: ENSP00000326107
MARARRAVVGSVRDVSTAATNLFYFTDFCIFLQPTHCFCCPEVSSSNYLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEVGRARPAGWHTPSLPSHSNWPTSASVVGTTGTRHHTQLIFFYCLLWAPSSHLQGPEGSFTG

SEQ ID NO: 79559 - protein, 154 aa, Homo sapiens
  Payload ID: 15840
  Gene Symbol: SSH1
  Gene Name: slingshot protein phosphatase 1
  ENSP ID: ENSP00000446652
MVSKAKVIVNGWLFPACLGFCLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIF

SEQ ID NO: 79560 - protein, 95 aa, Homo sapiens
  Payload ID: 15840
  Gene Symbol: SSH1
  Gene Name: slingshot protein phosphatase 1
  ENSP ID: ENSP00000447629
  MOD_RES (1)..(1): Any amino acid
XAMQDLESTRPDSPALFVDKPTEGERTERLIKAKLRSIMMSQDLENVTSKEIRNELEKQMNCNLKELKEFIDNEMLLILGQMDKPSLIFDHLYLG

SEQ ID NO: 79561 - protein, 37 aa, Homo sapiens
  Payload ID: 15840
  Gene Symbol: SSH1
  Gene Name: slingshot protein phosphatase 1
  ENSP ID: ENSP00000448586
MALVTLQRSPTPSAASSSASNSELEAGSEEDRKLNLR

SEQ ID NO: 79562 - protein, 692 aa, Homo sapiens
  Payload ID: 15840
  Gene Symbol: SSH1
  Gene Name: slingshot protein phosphatase 1
  Uniprot ID: Q8WYL5
  ENSP ID: ENSP00000448824
MALVTLQRSPTPSAASSSASNSELEAGSEEDRKLNLSLSESFFMVKGAALFLQQGSSPQGQRSLQHPHKHAGDLPQHLQVMINLLRCEDRIKLAVRLESAWADRVRYMVVVYSSGRQDTEENILLGVDFSSKESKSCTIGMVLRLWSDTKIHLDGDGGFSVSTAGRMHIFKPVSVQAMWSALQVLHKACEVARRHNYFPGGVALIWATYYESCISSEQSCINEWNAMQDLESTRPDSPALFVDKPTEGERTERLIKAKLRSIMMSQDLENVTSKEIRNELEKQMNCNLKELKEFIDNEMLLILGQMDKPSLIFDHLYLGSEWNASNLEELQGSGVDYILNVTREIDNFFPGLFAYHNIRVYDEETTDLLAHWNEAYHFINKAKRNHSKCLVHCKMGVSRSASTVIAYAMKEFGWPLEKAYNYVKQKRSITRPNAGFMRQLSEYEGILDASKQRHNKLWRQQTDSSLQQPVDDPAGPGDFLPETPDGTPESQLPFLDDAAQPGLGPPLPCCFRRLSDPLLPSPEDETGSLVHLEDPEREALLEEAAPPAEVHRPARQPQQGSGLCEKDVKKKLEFGSPKGRSGSLLQVEETEREEGLGAGRWGQLPTQLDQNLLNSENLNNNSKRSCPNGMEVGRARPAGWHTPSLPSHSNWPTSASVVGTTGTRHHTQLIFFYCLLWAPSSHLQGPEGSFTG

SEQ ID NO: 79563 - protein, 1423 aa, Homo sapiens
  Payload ID: 15841
  Gene Symbol: SSH2
  Gene Name: slingshot protein phosphatase 2
  Uniprot ID: Q76I76
  ENSP ID: ENSP00000269033
MALVTVQRSPTPSTTSSPCASEADSGEEECRSQPRSISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWSALQSLHKACEVARAHNYYPGSLFLTWVSYYESHINSDQSSVNEWNAMQDVQSHRPDSPALFTDIPTERERTERLIKTKLREIMMQKDLENITSKEIRTELEMQMVCNLREFKEFIDNEMIVILGQMDSPTQIFEHVFLGSEWNASNLEDLQNRGVRYILNVTREIDNFFPGVFEYHNIRVYDEEATDLLAYWNDTYKFISKAKKHGSKCLVHCKMGVSRSASTVIAYAMKEYGWNLDRAYDYVKERRTVTKPNPSFMRQLEEYQGILLASKQRHNKLWRSHSDSDLSDHHEPICKPGLELNKKDITTSADQIAEVKTMESHPPIPPVFVEHMVPQDANQKGLCTKERMICLEFTSREFHAGQIEDELNLNDINGCSSGCCLNESKFPLDNCHASKALIQPGHVPEMANKFPDLTVEDLETDALKADMNVHLLPMEELTSPLKDPPMSPDPESPSPQPSCQTEISDFSTDRIDFFSALEKFVELSQETRSRSFSHSRMEELGGGRNESCRLSVVEVAPSKVTADDQRSSSLSNTPHASEESSMDEEQSKAISELVSPDIFMQSHSENAISVKEIVTEIESISQGVGQIQLKGDILPNPCHTPKKNSIHELLLERAQTPENKPGHMEQDEDSCTAQPELAKDSGMCNPEGCLTTHSSIADLEEGEPAEGEQELQGSGMHPGAKWYPGSVRRATLEFEERLRQEQEHHGAAPTCTSLSTRKNSKNDSSVADLAPKGKSDEAPPEHSFVLKEPEMSKGKGKYSGSEAGSLSHSEQNATVPAPRVLEFDHLPDPQEGPGSDTGTQQEGVLKDLRTVIPYQESETQAVPLPLPKRVEIIEYTHIVTSPNHTGPGSEIATSEKSGEQGLRKVNMEKSVTVLCTLDENLNRTLDPNQVSLHPQVLPLPHSSSPEHNRPTDHPTSILSSPEDRGSSLSTALETAAPFVSHTTHLLSASLDYLHPQTMVHLEGFTEQSSTTDEPSAEQVSWEESQESPLSSGSEVPYKDSQLSSADLSLISKLGDNTGELQEKMDPLPVACRLPHSSSSENIKSLSHSPGVVKERAKEIESRVVFQAGLTKPSQMRRSASLAKLGYLDLCKDCLPEREPASCESPHLKLLQPFLRTDSGMHAMEDQESLENPGAPHNPEPTKSFVEQLTTTECIVQSKPVERPLVQYAKEFGSSQQYLLPRAGLELTSSEGGLPVLQTQGLQCACPAPGLAVAPRQQHGRTHPLRRLKKANDKKRTTNPFYNTM

SEQ ID NO: 79564 - protein, 1450 aa, Homo sapiens
  Payload ID: 15841
  Gene Symbol: SSH2
  Gene Name: slingshot protein phosphatase 2
  ENSP ID: ENSP00000444743
MALVTVQRSPTPSTTSSPCASSSHLEDSESAALLCCECEESEIFTDSNEADSGEEECRSQPRSISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWSALQSLHKACEVARAHNYYPGSLFLTWVSYYESHINSDQSSVNEWNAMQDVQSHRPDSPALFTDIPTERERTERLIKTKLREIMMQKDLENITSKEIRTELEMQMVCNLREFKEFIDNEMIVILGQMDSPTQIFEHVFLGSEWNASNLEDLQNRGVRYILNVTREIDNFFPGVFEYHNIRVYDEEATDLLAYWNDTYKFISKAKKHGSKCLVHCKMGVSRSASTVIAYAMKEYGWNLDRAYDYVKERRTVTKPNPSFMRQLEEYQGILLASKQRHNKLWRSHSDSDLSDHHEPICKPGLELNKKDITTSADQIAEVKTMESHPPIPPVFVEHMVPQDANQKGLCTKERMICLEFTSREFHAGQIEDELNLNDINGCSSGCCLNESKFPLDNCHASKALIQPGHVPEMANKFPDLTVEDLETDALKADMNVHLLPMEELTSPLKDPPMSPDPESPSPQPSCQTEISDFSTDRIDFFSALEKFVELSQETRSRSFSHSRMEELGGGRNESCRLSVVEVAPSKVTADDQRSSSLSNTPHASEESSMDEEQSKAISELVSPDIFMQSHSENAISVKEIVTEIESISQGVGQIQLKGDILPNPCHTPKKNSIHELLLERAQTPENKPGHMEQDEDSCTAQPELAKDSGMCNPEGCLTTHSSIADLEEGEPAEGEQELQGSGMHPGAKWYPGSVRRATLEFEERLRQEQEHHGAAPTCTSLSTRKNSKNDSSVADLAPKGKSDEAPPEHSFVLKEPEMSKGKGKYSGSEAGSLSHSEQNATVPAPRVLEFDHLPDPQEGPGSDTGTQQEGVLKDLRTVIPYQESETQAVPLPLPKRVEIIEYTHIVTSPNHTGPGSEIATSEKSGEQGLRKVNMEKSVTVLCTLDENLNRTLDPNQVSLHPQVLPLPHSSSPEHNRPTDHPTSILSSPEDRGSSLSTALETAAPFVSHTTHLLSASLDYLHPQTMVHLEGFTEQSSTTDEPSAEQVSWEESQESPLSSGSEVPYKDSQLSSADLSLISKLGDNTGELQEKMDPLPVACRLPHSSSSENIKSLSHSPGVVKERAKEIESRVVFQAGLTKPSQMRRSASLAKLGYLDLCKDCLPEREPASCESPHLKLLQPFLRTDSGMHAMEDQESLENPGAPHNPEPTKSFVEQLTTTECIVQSKPVERPLVQYAKEFGSSQQYLLPRAGLELTSSEGGLPVLQTQGLQCACPAPGLAVAPRQQHGRTHPLRRLKKANDKKRTTNPFYNTM

SEQ ID NO: 79565 - protein, 48 aa, Homo sapiens
  Payload ID: 15841
  Gene Symbol: SSH2
  Gene Name: slingshot protein phosphatase 2
  ENSP ID: ENSP00000462583
MALVTVQRSPTPSTTSSPCASRWGLAWGLAAQAGLELVASRDPPVSAS

SEQ ID NO: 79566 - protein, 112 aa, Homo sapiens
  Payload ID: 15841
  Gene Symbol: SSH2
  Gene Name: slingshot protein phosphatase 2
  ENSP ID: ENSP00000462605
MALVTVQRSPTPSTTSSPCASEADSGEEECRSQPRSISESFLTVKGAALFLPRGNGSSTPRISHRRNKHAGDLQQHLQAMFILLRPEDNIRLAVRLESTYQNRTRYMVVVST

SEQ ID NO: 79567 - protein, 116 aa, Homo sapiens
  Payload ID: 15841
  Gene Symbol: SSH2
  Gene Name: slingshot protein phosphatase 2
  ENSP ID: ENSP00000465703
  MOD_RES (1)..(1): Any amino acid
XRLPHSSSSENIKSLSHSPGVVKERAKEIESRVVFQAGLTKPSQMRRSASLAKLGYLDLCKDCLPEREPASCESPHLKLLQPFLRTDSGMHAMEDQESLENPGVICKEHALYWLIL

SEQ ID NO: 79568 - protein, 48 aa, Homo sapiens; identical to SEQ ID NO: 79565
  Payload ID: 15841
  Gene Symbol: SSH2
  Gene Name: slingshot protein phosphatase 2
  ENSP ID: ENSP00000466607

SEQ ID NO: 79569 - protein, 120 aa, Homo sapiens
  Payload ID: 15841
  Gene Symbol: SSH2
  Gene Name: slingshot protein phosphatase 2
  ENSP ID: ENSP00000467164
MEADSGEEECRSQPRSISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGL

SEQ ID NO: 79570 - protein, 42 aa, Homo sapiens
  Payload ID: 15841
  Gene Symbol: SSH2
  Gene Name: slingshot protein phosphatase 2
  ENSP ID: ENSP00000468037
MALVTVQRSPTPSTTSSPCASRAELGFLVQGGRFPVIVRKNL
